United States Patent 12,746,261 (PROBIOTIC BACILLUS COMPOSITIONS AND METHODS OF USE) - sequence listing, part 2

SEQ ID NO: 3 - DNA, 1000000 bp, Bacillus amyloliquefaciens
gagccgtttacgtgggcgagcggcattttatcaccgatctattgtgacaaccgtctgacattgtcgtatccaaaagtgagaaatgatgtggcggacgggctcggcaaactgctgaaggagcatttccccgaggcggagatgatcgcgggcactgcaacggcgggcattccgcatgctgcgcttctcgcagaccgtacaggcgcgccgatgtgctacgtcagaagcaaaccgaaagcgcacggcaaaggaaatcaaatagaaggcgccattaagaaaggacaaaaaacagtcgtgattgaagacttgatttctaccggaggcagcgtgcttgaagctgcggcggcccttcaaagagagggcgcggaagtcctcggcgtcatttccatttttacatacggactgccgaaagcaacagaagcctttaaaaaagcgggtcttccttattactcgttaaccgattatgacacgctgattgaagtcgcgcttgaaaacggtacgattcattcagctgacattgaaaaactgaaatcatggaaactgaatcccgagtcaaaagattggtttaaaaaataatgacaataaaaacaggcctcagggcctgttttattattcctatcaaaaaactcgggttgacttctgttagaattgtgctaaaatttagtacaaatctaaaaagcttatcaagagcggctgagggactggaccgatgacgcccggcaacctgcgtgtattgcaaggtgccgcatccagaaaaatgcacagcattttgaagataagggctataccgggtcactgtctttcattccgctggattgaaagttttttatatgaaaaaaagattgagggataagacaaccggcagagaacaacaactgtttgattgtctccgggaggaggaaagaaaaaatgctaacgtatgatacatgggaggaaccggcgattacatttccggaagacgattcctataaaggcgcgctgtccgttttaaaatgggcatacggccactacggagaccagcttgtttacgcgtgcagcttcgggattgagggcatcgtcctgatcgatttaatttctaaagtaaagaaagacgcggaaatcgtgtttctcgatacgggtcttcactttaaagaaacatatgaaacgatcgaaaaagtgaaagaacgttatccggggctgaacattatcctgaaaaagcccagccttactctcgaggaacaggccgaggctcacggagataaactgtgggaaagagaaccgaaccagtgctgctacatcagaaaaattctgccgttaagagaagcgctcgcagggcatccggcatggctgtccggccttcgccgggatcaagggccgagccgggcgaatacgaatttcctgaataaagacgacaagtttcaatcgattaaagtatgcccgctgatccattggacatggaaagacatctggagatatacttccaagcatgagctggattacaatatcctccatgatcaggggtatccgagcatcggctgtgaaccgtgcacttcacctgcgtttaccgcggaagatttgcggagcggcagatggaacggcatggcgaaaacagaatgcggactgcatgaataaaggagctgcccgatggaattagccgctattttattctgtctgttttttgccatgaatatcggagccagcggagccgcggcatcaatgggagtcgcttacgggtccggcgccgttaaaaagaaaacgtatgcgctgatcatctgcgcggccggagtcctgtcaggggcggttatcggcggcggtgaagtcgttaagacgatcagcggcggaatcattcccgaacaaaccattacgctcaccattgtctgcattataatcggagcggcggcgctatcgttattcacggcgaatgtgctcggcattccgctgtcgacgagtgaggtcactgtcggggcgattgtcggtgtcggcgtcgcgtacaaagtattgtttttacagcatcttttggtcatcgtgattttttgggtgctcgtaccgttcgtcgcgttctgtttcacttttctcgtatcgaaggtattcagttctctgaatattcgagtcatttcgaaacggaaacagaagattttaggaattgtgctgctttttgcggggttttgggaagctttttcagccggaatgaacaatgtcgcaaatgcggtgggccctttggtggctgcgggcgtactcagcgtgtcaaaaggaacgctgtacggaggcatctttgtcgctctcggcgctctgcttttaggacgcaaagtgcttgaaaccaacgggaaaaagattacgaggttttcagccggagaaggcatactgctttcaggaaccggtgcggggcttgtcattatcagttccgtcttcggtctgccggtcccattggcgcaagtcacatcatcatcaattatcggtatcggaatggccaaaaacgggccgaacgtttttcataaagaagtcgtgaaaacgatgctcaaagtatgggttgtttcgccgtttttgtcactgtcgatttcgtatctgcttgtctccctgctgttaaaaggagattactattccatctttatgatggccagcgtgcttttggcagctggcggagccgccagtctgatgaaagccatccgaaaagagaaacgctctgtccatgaacaaggcgggggcatttaactattaatctgagtttatttatctgttaactgggaggaatcatgtattatgagtttagcaccgcacggaggaacattaattaatcgggtgaatgagcagtatgatcttacatccgtccacaaagaaattgagcttgatttgatttcgttcgctgatttagagctgatcgggatcggggggtacagcccgattgaaggatttttcacagaaaaagattacgtatcagtcgttgaaaatatgcgtctagcatcagggttgtctggtccctgccgatcacgcttccggtcgattcagaaaaagcggctgagcttgccgtcggcgacacggtgaaactgacttacggcggagaaacatacggcgtcgtcgacatcgaagatatttatacgccggataaacaaaaagaagccgttcacgtatataaaaccgatgatgccgcgcatccgggcgtgaaaaaattattttcacgcggcgatacgtatgtcggcgggccgatcacattaattaaaaaagcgtcaaagcagtttcctgagtttacatttgaacctgccgatacaagacgaagcttcgaagaaaaaggctggaaaaccatcgtcggtttccaaacgagaaatccggtccaccgcgcccacgaatatatccaaaaaaccgcgcttgagacggttgacggcctgtttttgaacccgctcgtcggtgaaacaaaatcagatgacattccggcggatgtcagaatggaaagctaccaggtgctgctcgatcattattatccgaaagaccgcgtattcctcggcgtgtttttggcggcaatgcggtatgcggggccgagagaagccattttccacgcgcttgtccgcaaaaactacggctgcacgcattttattgtcggccgcgatcatgccggcgtcggtgattactacggcacatatgaagcgcaagagctgtttgatcaatttacagcggatgaactcggaattacaccgatgaaattcgagcacagcttcttctgccagaaatgcggcaacatgggaacggccaaaacatgtccgcatgacagagaagaccacgtcattctgtcaggaacaaaggtcagagaaatgctgcgaagcggcgtcatgccgccggcggaattcagccgtcctgaagttgtcgaggtgttgattaaagggctgaaaacgaaagaagaagcaggcgtttcttaaggaggaaaatagagtgacaaatcgtgatatcgtatggcatgaagcctcaataacgaaagaagaataccagcagaaaaacaagcataaaagctctatcctctggctgacgggcttaagcggttcagggaaatccacaattgcaaacgccgcagcgcgcgagctgtttgaacaaggctatcaagtcattgtgcttgatggggataacatccgccacggcttaaacaaggacttaggtttttccgatgatgaccgcaaggaaaatatacgccgcatcggggaagtggcgaagcttttcgttcagcagggaaccatcgtcatcacggcttttatttctccgttccgtgaggacagagatcaggtgagagagcttgtggcagagggcgaatttaatgaaatctacgtgaaatgcgacctcgatatatgtgaaaagcgcgatccgaaagggttatataaaaaagcaagaaatggtgaaattccgttctttacggggatcgactcaccgtatgaagagccgaaagcgcctgagctcgtacttgattcaggcaaatttgaacgtgaagaatgcaccggaagactggttgactttgtgaaaaacagcttagcataataggtccaaaaaggccgcgcaatcagccggatatcccccgcaatggcgggatatggtaaaatagctgaagtgcggcctcgcggctgttctgggaagatttcaaaacggatcggggagacatgctatggggaaagtatttatcgttggagccggtccgggagatccggacttattaacggtgaaggcaatgaaagccatacagaaagcggacgttatattatatgacagattggtaaacaaagagattttacagtacgccggagaagaagcggatctgatttactgcggcaagctcccggattttcacattatgaaacaggatacgatcaaccgtttccttgtgaagtatgcgaaaaaggggaaaaccgttgtaaggctcaaggggggcgacccgtttgttttcggccgcggaggcgaagaagcggaggctctcgcgcaaaacgccattccgtttgagatcgttcccggcattacatcaggaatcgcggctgctgcttatgccggcattccggtgacgcacagagaggcgagctccaatgtcgcattcgttacggggcattataaacaagaagacgactttgaagaaaaatggaaagcgctggcgacgggcattgatacgctggtgatttatatgggaattaaaaatatccggcagattgaaagaatgctgctggaaaacggcagagacggcggcactccggcagcctttattcattgggggacgacggacaggcaaaaaacagtcgtctgcaccgtcggcacgctttcagacacagtgataaaagaagaaatcaaaaacccgagtttaattgttatcggtgatgtcgtcaattatcactgcatactggactggtatgcatctgatcagaaaaatccggatttgagcgaggcgttgtaaatgaagcaggcgattttatatatcggacacggaagcaggctgaaaaaagcgcagacagagtcggcggcgtttttaaaagggtgcatgccacacgctgacgctcccattcaggaaatctgttttttagaactgcaggaaccgtctattgaagcgggatttgaagcttgtgtcagacaaggcgccactcatattgcggctgtgcctttgctgctgttgaccgctgcccacgcgaaacatgacattccggctgaaatcgcccgtgcggcggccctgcatcccgatataaaagtgacatatggtgttccgatcggagtggacgatgaagtcgtaaaagccgtgcatcatcgcattgaagataccggagtgtccattgagcaggcgaaagtggtgctgatcggaagaggaagcacagatccggcagttaaaagcgcagtcagtgagattgccggaaaacttgaggcgattacacctgttaaagaagtcatcccttgttttttaacagcatgtgacccgcactataaagaagtgtttgccggccttgaagaggatgacggagcacccgtttttatcgttccatatcttctgtttaccgggcttttaatgactgagattgaacgggaagttcaaaagcttcaaacggtcaatcaaaatgttcatctcgcttcatacttaggttttcacccgcatattaagcaggcgtttttgaaccgtgtgacggaagctgtccgaaaccccggcgggcagtttgattttaaggggggacagtatgctgcctctgcacattaatctcagcggaaaaagaattgtcatcgcgggcggaggcaatgttgccttaagaagactcaaaacagtgctttcggaaggcgcggatattactgtaatcagtcccgatgccctgcctgaaattaaacagctggcggatgaaggacgtatccgctgggtttcccgtaaaattgacatgaaggatctcgcgcccgcttttttcatcattgccgcgacaaatgaccgcaacgtgaatcgggagataaccgagggcgcttctgaaacgcagctggtcaattgtgtaagcgaggctgaacggggcagcgtgtatatgccgaagatcatccgcaaagggcgcattcaagtatccgtatcaacaagcggcgcaagccctgcacatacgaaaagactggctgaggacataaagcctctcattactgctgatttggctgaagaagtggatcgattatttgagaaaagaagaagaccataaaaaacaccctgtctgtcatcaggcagggtgttttttatactgtcctgacagtccgccgaatgtgaaaaattcaaaacgaaagcgggcagtttgaatggtatatgccgacaagcggtcaggattgcgaagtgatgcggaatatgtatgtgatcccgatgccgcctggatttcgcccgcatacaaaggaaaggtcagagacccgcccggatgtgctcaggttcggcgagggaaggtgaaagtatccgccgccaaatcaggtgtgaccgtttaaatcacagacggcccggcggatcatgcagacatgacgggaaactgatcagatactgtaaagatcggttctgacggctgggagagtttcgtctccgtttatacgtaataaaaaacacttccaagccgagtgcgggtttcagcttggaggtgcgtttattttttcagccgtatgacaaggtcggcatcaggtgtgacaaatacggtatgctggctgtcataggtgacaaatccgggctttgcgccgtttggctttttcacatgtctgatttttgtataatcaaccggaacggagccggaatctttcgctttggaaaaataagcggcgatcgcagccgcctccagtatggattgttcatccggatcgctgcttttaatcacaacgtgggaacccggaatgtctttcgtgtggaaccataaatcatccctcgcggcagcttttgtcgttaagtactcattttgtttattgtttttgccgacaagaatcgtcaatccccgtgaagattcatattgctccaaaacaggaacgtgctgcttctgttttttctgtcctctctgctgtttcggccgcagatatttgccttccacaagctcttcccttatttcgtgaatatcctttgtggaggcggaggagagctgctggatcagctgatcgaaataagcgatttcctcctcggccagacggatctgttcttttaccacctcgacggaattcttcgccttttgatactttgtaaaatacatctgcgcgttttctgacggtgttttgttcggatttaaagggatggtcaccgtcttactttcttcatcataataattgatgacttccgcttctttgtcaccttttttcagcatatacaaatttgccgtcagcagttcgccgtatagctggaattccttcgcattttctgagtagtcgagcgtcttttccagcttttttatcttattggcattctttttccgttcatttgcgacaaaacgctcgagatcctgagcctgctgtttgacgcggtcgcgttccgctttgccgaaataaaaccggtccaacagctcactcagtgagtgaaaggtgcgctcctctccgtttacatgtgtgagagacaggagataaaagtattcctttccgccggctgtcgtaatgttcggtgtaaacctgcaatctttcacggcatggaacatttcaatcagcgtcttcggcagcgttattttgttagcgagacccgctctgtgcacggcttcttttgcaaacagcggagaaacaccggagaaatgtctgacgatctgctggtcaagccgtccttcctgaaaactgagataacgcaaaacgtcctcttcatccgcggcaagcggcgaaattttttcctgagcgggaggaagcttgtaatcatagcccggcagaacggtccggtagctgttcatcgacggagataaatgcttcagcccgtcgatgatggatccttctccgtcagtcagaataatattgctgtgccgtcccataatttcaacatacagcgttcttacggtttcgtcgccgatttcatttctgctttttatgcggaatatcataatccggtctaatccggcctgttctattttctcaataaatccgccttctatatgctttctgagcagcatacaaaacatcggcggctcgctcggattttcataggcctggtttgtcatgtgcacccgtgaatagctcggatgcgccgacaataataatttgtggtttgttccgttggcgcggatatggaatatcacatcgtgcttaaaaggctgatggactctcgtgatccgtcctccggcgatccggctgtttaattcatgtgtcattccgtatgtaaacatgccatcaaaagacatataaaacaccctttccttcttcctgcattcgataattatagcatgaaaagggacgagtcagaataagcttgtttacagagtgacatctctaaagcgaggcaggggagtggacgagaagaatgaagtttcatgaaatgggacaaaccgatttgctgaaagcaacaaatacgtccattaaacaggggttgaccgaaaaagaggtgaaaaaacgccttgaaaagcacgggccgaacgagcttcaggagggcaagaggacaccggcgatcgccgtgtttttcgcccaatttaaagattttatggtgctcgtgctgctggcggcaaccttaatatccgggtttttaggcgaatatgtagatgccgtagcgattatggcgattgtatttgtcaatggggttctcggtttttttcaagagcggcgggcggaaaagtctttacatgcattaaaagagctgtcaacgccgtatgtgtcagcgttgcgggacgggagctggaagaaaattcagtccaaggagctcgttcccggcgatatcatgaaattttcaagcggcgaccggattggcgcggatgtgcggatcgttgaagcgaaaagccttgaaattgaggaatcggcgctgaccggggaatcaattccggtggttaaacaagccgataaattgagaaagccggatgtttcgttaggcgacatcagcaatatggcgtttatgggtacgatcgtaacgcgcggcagcggtgtcggcgtcgtcgtcggtacaggaatgaatacggcaatggggaaaattgccgatatgctggaatccgccggcagcctttcaacaccgctgcagcgaagacttgaagagctcggcaaaattttaattatcgtcgcgctccttttaacggtattggtcgttgcagtcggcgtcttacagggacatgatctttacagcatgtttttggccggggtgtcattggccgtcgccgcaattccggaagggcttcccgccattgttacggtggcattatcaatcggcgtccagcgcatgatcaaacaaaaatcaattgtcagaaagctcccggcggttgaaacattgggctgcgcctctgtcatttgttctgataaaaccggcacgctgacacaaaacaaaatgaccgtcacccatatgtggtcaggcggcaaaatttataaagtgtcaggcatcggctatgtgccggagggcgttttcacccgagatgagcgggaaatcaagccgaaagatgagaagattcttgaacagatgctggttttcggcgcgttgtgcaacacatctgaaatcgcactgaaagacggccgttatgtactcgacggtgatccgacagaaggagcgctgctgacggctgcaagaaagggcggctattcaaacgattggctcagcgggcattaccgcgtggttgccgagtttccgtttgactccgtccgcaaaatgatgaccgtcattgtagaggatcaggaaaaaaagcagttcgtcatcactaaaggagcgcccgatgtgctgattgaccgctcgtcacatctgatgcacggcgcaagaagtacgcctttttcaggagaaaagaaagcagaaacggaagcggttctgaaagagctggcgtcgcaagctttgcgtacgattgcgattgcttataaaccgcttaagcccggagaaaagccgacaatggagcaggcggaaaaaaatctgacgatgctcggcttgtcaggcatgattgatccgccccgtccggaggtcagacaggccattaaagaatgccgtgaagccggcattaaaacggttatgatcacaggggatcacgtcgaaacggcaaaggccattgcaaaagatttgcgtcttcttccgaaaaaggggcgtgtgatggacggcaagacgctgaatgagcttacggacaaagaacttatcgaaacggtcgatgatgtctacgtcttcgcacgcgtgtcacctgaacataaattgaaaatcgtcaaagcgttccaggaaaacggacacgtcgtcgccatgacgggagacggggttaatgacgcgccggccataaagcaggcagatatcggtgttgccatgggcgtgacgggaacggatgtggcaaaggaagcctcttctctcattctggtagatgataactttgctacgattaaatcagccataaaagagggacggaatatctatgaaaatataagaaaattcgtccggtatttgctggcctccaacgtcggtgaaattttagtgatgctgtttgcgatgcttctcgctctgccgctgccgctcgtcccgattcagatattgtgggtgaacttagtcactgacgggctgccggcgatggccctcggtatggatcagccggaaggagacctgatgaggcggaagccgcggcatccgaaagaaggagtgtttgcgagaaaactgggctggaaagtcgtatcaagagggtttttaatcggagccgcaaccattttagcgtttatcatcgtctatcaccgcaatcctgaaaatctgccctacgcacagaccgttgcattcgcgactcttgtcctggctcagcttatacacgtgtttgactgccggagcgaaacgtctgttttctcccggaatccgtttgaaaatatttatctgctcggcgccatcgtttcttctgtcttcctgatggccatcgtcatctattatccgccgctgcagccgattttcaaaacagtgccgattacgccgggcgattggatgctgattatcgggatgtctggcatacctacttttttgctggcgggttcacttttgacaagaaaaaaataattccatatgatataatcttaggggtaatagcatgtctattgcccttttattttgataacgggaaagaattgggtgtttcatatgatacggagtatgacaggcttcggcagcgcaagcagcacaaaaggcgatctctcggcaaccgttgaattgaaatccgtcaattaccggttcaaagaagtgaacgcccgcctgccacggcctttgctatatgtagaggataagctgaaacaaacgatattgcagcatatacagcgcggaagagtagagctgtttctcactgtcaacagtgacgcgctcataaaaagaagcctgaacatcgattgggagctccttgatgaatatgtgagcgccgcacgcgccatgaaagagcgctacagcctggccgcagaacccgatgcaatggatttctttagatttgaacatattgcgcagattcacgaagaacagatgcgtgatgacaagcttgaagaagtcatcagggaagccgctgagctggctgtaaaggaactttgtgacatgagggaaaaagaaggccggcttttggcggaagactgctttctgcacattgagcggcttgagacgctgtccgaacaggtgaaagagcgcgcttcggccgttgttattcaataccgcgagcgtctttacgcccgaatgaaggaatggacggaggacgcgctcgacgaaagcaggctgatcacggaatgcgccattttcgccgatcgttctgatataacggaagaaattaccagattgaagagccattttgttcaattccgtgatatattaaaagaaggcggggcagtcggccgcaaacttgatttccttgttcaggagcttaaccgggaagcgaacacgatcggctcaaaagccaatgatcatcaaatcacaaagcttgtcgttgaaatgaaaagttctattgaaaaattgaaggaacaagtgcaaaatatagaatagcgactgtgcgtattgtttacagacggtctcttcaggttacactagagacgtctattttacagggggaacgtagaagatgacgattaaactgattaatatcggatttggcaatatcatctccgccaatcggatgatttcgattgtcagcccggagtctgcgccaataaagcgaatgatccaggatgcaagagaccgcggaatgctaatagacgctacatacggacgaagaacccgtgcagttgtcgtcatggatagtgatcacattatcttatctgccgtccagcctgagacagttgcacacagactttctgtgaaagaagaaattatggatgaagggcaggggtaattgccgcatgaaagaaagagggttattaatcgttctctcaggtccctccggagttggaaaaggaacggttcggcaagcaatattttcacaacaggacacgaaatttgaatactcaatttcagtcacgacgagaaacccgagagagggcgaggtcgacggcgtcgattatttctttaaatccagagatgaattcgagcgcatgattgaaaacaacaaactgcttgagtgggcagaatatgtcggcaactattacggtacgcccgttgattatgtcgaacagacgcttcaagaaggaaaagacgtcttcttagagattgaagtgcagggcgcgctccaagtgcggaatgcatttccggaaggcctgtttatcttcttagcgccgccgagtctttctgagctgaaaaacagaatcgtgacaagagggactgaaaccgacgatttaatcgaaaacagaatgaatgccgcaaaagctgaaatcgaaatgatggacgcgtatgattatgtcgttgaaaacgacgatatccaaacggcttgtgataagattaacgcaatcgttctcgccgagcacttaaaacgtgaacgcgttgctccgagatataagaaaatgctggaggtagaataacttatgttagatccgtcaattgactctttaatgaataaattagattctaaatatacgctggtgactgtgtctgcaagacgcgcgcgtgaaatgcagatcaaaaaggaccagcagattgaacataccatttctcacaaatatgtaggcaaagctttagaagaaattgacgcgggcctgctttcgtttgaaagagaagacagcgaataacaagcacacgtagcaacctatctctacataggttgttatttttttccgtttgggatttgtccaatgctttcataaaggaggagaagacttcatgaaaaaccgaaacattttgctatgcgtaagcgggggaattgccgtttataaagcttccgcactcacgagcaagctggttcaggccggcgcaaatgtcaaagtgattatgactgagtccgcgcgtgagtttgtttctccgctgacatttcaggcgctgagccggaatgaagtgtatacagatacatttaatgaacaaaatccgaaggtgatttctcatattgatgccgctgactgggcggatttaattattgtcgcgcccgctacggcaaatattatcggcaagcttgccaacggaattgctgatgatatgctcacaacgacggtgctggcggctgaggccccggtctgggtggcgcctgcgatgaatgtccatatgtatgatcatccggcggtgaaacggaacatctctgtgctttatcaggacggggtccgctttatcgagccgagtgaaggctatttggcatgcggatatgtcggcaaaggaaggctggaggagccggagcttattgttgagcgtgtcagagagcattttaaggagcctgaagacgatgcgccgctgaaaggaaaacatattgtcattacggccggtccgacgcgcgaagccgtggaccctgtccgcttcttcacaaataaatccaccggcaaaatgggctacgctgctgctgaagccgccgtccgtctcggggcgcgggtgacgctgatttcaggcccggtgtcaatagagccgccagtcgggctgtatcagtttcttcctgtgcaatcggcagccgatatgagagaagccgtgctttctgtgtttgattcatgcgacatggtgattaagacggcggccgtggccgattttacgccggcggctgtttctgatcacaaaatgaagaagaaagacggttcgctcgtgatcgaattcaaccgtacggcagacatactgaaagaactcggcgaacggaaaacacaccagctgctggtcggatttgcggctgaaacgcaagacgtcgaacgctatgcgcgcagaaaactcgaacagaaaaaccttgatatgatcgttgcgaatgatgtgaaagcggaaggggccggatttggcacggatacgaatgtcgtcaccttctatttccgggacggaagaaaacgggagcttgcgcttatgtctaaacttgacgtttcctttgaaatgctgaaggaaatgacagctttgaaagccgaggaccgaaaacccgtatgaatgtagcagaagtcattgtcgatgtcagctccaaaaacattgacagaccctttgattacaaaattcccgatcatttaaaagggatgatcgaagtcggcatgcgggtgattgtcccgtttggcccgcgcaagcttcaaggatttgtgaccggtttgaaagattcgtccgaattaaacggcggctcaatgaaggaagtcgagaagcttcttgatttgacgcctgttctgactgaggaactgatgcagctgtcttcatggctttctgacaaaacgctgtcgtttaaaatcacggcgcttcaggcaatgctgcccgccgcattgaaggcgaagtacgagaaagagctgaaagtcgttgacgaagaagcgctgacaccggacatcaaacagcttttcaggaatcaaaaaagtcttctgtactcggatattaccgatgaaagcattctttcgtcacttcagaaattcgtgcgtaaaggaagcattgatgtcacatataaagtcgcccaaaaaacgaataaaaaaatgatccgcatgattgaagcgggggcagacaaagaagaactcgcccggcacgcagattcattgacaaagcaggcttctaaacagctcgccgtgcttacttattttatcggcgggggagaaaagatttccgcggctgaactttgcaaaaagaccgattccagttccgcgacgctgaaaacgcttcttaaaaaggggcttcttacggaaagctttgaggaggtttaccgcgatccttatcaggacagaatgttcaaaaaaacagagccgctctctcttacagaagagcagcaggccgcttttgagccgattaaacaagctgtagccgaccatgtccatcacgtctttctgcttcacggcgtcacgggaagcggcaaaacggaaatttacctgcaatccattgaaaaagtgctggcaaaaggacaagaagccatcgtgctcgttccggaaatttcgttgacaccgcaaatggtcaaccgttttaaaggccgcttcggctcacaggttgcggtcatgcacagcggattatccacaggtgaaaaatacgatgaatggcggaagattcagcgcaaggaagtccggcttgtcgtcggagccagatcggccatctttgccccgtttgaaaatctcggcatgatcattattgatgaagagcacgaatcttcctataagcaggaggaaatgccgcgatatcatgcgaaggacgtagccatccgccgggccgagcatcacagctgtccggtcgtcctcgggagcgccacgccgacattggagtcatttgcgcgggcgaaaaaaggcgtttatgagctgcttccgttaaaacatcgcgtaaaccgccagctcatgcctgacgtttctctcgttgatatgagagaagaactgagaaacggcaacagatcaatgttctcaagagagctgatggaacagctggaagagaagcttgcaaaaaaagagcaggccgtcctttttctgaataaacgggggtattcctcgtttgtgatgtgccgggactgcggttatgtgccgcaatgtccgcattgcgacatttccatgacttatcaccgctacggacaaaggctgaaatgccattactgcggccatgaggaacctgtcccgggaacatgcccggaatgcggaagcgaacatatccgctttttcggcacgggaacacagcgtgtggaggaggagcttaccaaagtgctgcctcaggcgcgcgtgatcaggatggatgtggacaccacttcaagaaaaggcgcccatgaaaaactgttgtcagcgttcggtgaagggaaggcggatatcctgctcggtacgcagatgatcgcaaaagggcttgattttccgaacgtgacgcttgtcggagtattaagcgccgatacgacgcttcacatcccagatttcagggccgcggagaagacattccagctgctgacacaggtaagcggacgggccgggcggcatgaaaagccgggaacggtggtcattcaaacgtatacaccgtctcattacagcattcagctgacgaaaacgcacgactatgaaactttttttcagcaggaaatggcgcacagacgggcccagtcatacccgccgtattattacgtggcgctggtgaccgtttctcatgaagaagcggcaaaagccgcggtcaccgcagaaaagattacaaactatttaagagcgggatgcgggcctgatacgaaaattctcgggccggcggcttccccgattgccaggatcaaagatagatatcgctatcaatgcgtgataaaatacagacaggaaaacgagttgcagattcagttgaaaaagatactggagcactataaacgcgacattgcgcaaaagcatgtaatgatttcaattgatatgaatccgtacatgctgatgtaacattagtttttggagggcaaaattttggctgtaaaaaaaatcgtcacacacccggcggaggttctggaaacacccgccgatgaagtgacagtgtttgataaaaaattaaaaaaactgcttgacgatatgtacgatacgatgctcgaaatggatggcgtcggtctcgccgcgccgcaaatcggcattttaaaaagagcggccgtcgtggacatcggtgaagaaagcggccggatcgaccttgtaaatccggttattcttgaaaagagcggtgaacagaccggagtcgagggctgcttaagttttcccggggttttcggtgatgtcacccgcccggattacgtaaaggtaaaagcccacgaccgtaaaggaaaaccgtttattttagaagcggagggttttttggccagagccgttcagcatgaaatggatcatttagacggcattttattcacatcaaaaattacggcttactacactgaagaagaactggcagaaatggaaggatgattggatgacaaggatcgtttttatgggaacgcccgacttttcagttcccgtcctgcgcacgcttattgaagacggatatgaagtggttggtgtcgttacgcagcctgaccgcccgaaaggcagaaaaaaaatcatgacgcccctcctgtaaaggctgaagctgaacgtcacggcattcccgtgcttcagcccgaaaaagtaaggctcgaagaagaaatagaaaaagtgctaagcctgaagccggacctgattgttacggcggcattcggacagatcctgcccaagcagctgctggacggtccgaaatacggctgtatcaacgtacacgcgtcactattgcctgaattaagaggcggagcgccgatacattattcgattctccaaggcaagaagaaaacaggcgtgacgatcatgtatatggttgaaaagcttgatgcgggcgatatgatttctaaaatcgaagtggaaattcatgaaacggataacgtcggcacgctgcacgacaaattaagcatagcgggggcaaagcttttgtcagagaccgtcccgaacgtcatctccggaaatattaaaccgatcaaacaggacgaatcaaaagcgacttacgcgcctaacattaagcgtgagcaggagcggattgattgggcaaagcccggagaagagatctacaaccagatcagaggtttaaacccttggcctgtcgcctatacaactttgaacggtcaaactattaaagtatgggcttctgaaaaagttgcggcaaaaactgatgctgcgcccggaacagtcatccgcacggagcaaaacggcattgtcgtcgcatcaggaaacagcaccgcccttttaatcactgagctgcagccggcggggaaaaaacggatgaagggcgaagattttgtaagaggcaaaaatgtgcagcccggtgacgtgttaggagcagcaaatgaagaaaattaatgtccgggagctcgcccttgaagcgcttgagaagcttgagcaaaatcaggcatacagcaacctgcttcttacatcggttatcaaaacgaacacgctcagcgatcaggacagaggactgctgacagagcttgtctacggaacgctgcaaaataaaatcgccttagactatatgctgaagccttttatccgcaagccgaataaggtgaagccgtgggtgattcagctgcttcgtctgtccgcgtatcaaatggagtatttagaaaaaattccggatcgcgccgccatccatgaagcggttgaaatcgccaaaaaacgcgggcataagggcattgcgtcctttgtcaacggcattctccgctccctgcagcgtgagggggcgccgtcatttgctgaaattgaagacccggttctccgtctttctacagagacaagccatcccgaatggctcgtaaaagagtgggtcgaggcgtacggctttgaggcggctgaaaaaatctgccggattcatctcattccgccgaagcagacgctccgtgtcaatcacataaagagcgacagggaaacggtgctgaatgagatggagaatgccggtctggaagcggaagccggagacctttctcctgatgcgattaagcttttgaaaggaagcatcgcgaacacggcatttttccaaaacggccgggtatccatacaggatgaaagctcaatgcttgtcgcccgggcgctggacccgaagccgggcgaaaccgttttagatgcatgcgccgcaccgggcggaaagtcggctcacattgcggaactgatggagaacgaggggagcctcacatcgcttgatcttcaccgtcataaagtgaagctgattaaagagggcgcagaacggctcggtcttacgatcatcgacgcgcaaacgatggatgcgcgaaaagcgggagaggcctttggcgcagaacggtttgaccgtattctcgttgatgccccttgctcaggtttcggcgtcatcagaagaaaacccgatatgaaatatacgaagacgccggaggacagcagacggctgtcagaaatccagctcggcattttaagggaaatcgccccattagtaaaaaaaggtggcacactcgtatacagtacgtgtacaatggatcggacagaaaatgaagaagttatgcatgcgtttatacaagaacaccctgagtttgaacccgatttgtctcttgaaaagcggctgcctgaaaaggcgagaccctttgttcaggatggaagccttcaaattcttccgcattatttcggaacagacggtttctttattagcagcatgagaaagaagggataaaaatgacacaattaaaaaagacaagcgtacggaaagagctgcggactgagcagccgtccatttactcttttgaattagatgaaatcaaacaatggctgaccgagaatggcgaaaagccgttccgcgcagcacagatttttgaatggctctatgaaaagcgggtttcttcatttgatgaaatgacgaacctctcaaaaagcctgcgtgaaaaactcgagagcaattttgtgctgacaacgctgaaaacggctgtaaaacagacatctcaagacggcacgatgaaatttttatttgagcttcatgacggttatacgattgaaacggttttaatgagacacgagtatggtaattctgtatgtgtaacgacacaggtcggctgccggatcggctgcacattttgcgcgtcaacgctcggcggtctgaaacggaatcttgaagcgggagaaatcgtcgctcaagtcgtgaaagtgcaaaaggcgcttgatgaaacggatgaacgcgtcagctcagtcgtcatcatgggaatcggagagccgtttgataatttcaatgaaatgctcgctttcttaaaaatcattaaccacgataaagggctgaacatcggagcgcgtcatatcacagtttccaccagcggaatcattccgaagatttacgatttcgccgatcaaaaaatgcagatcaatttcgcgatttctctgcatgctccgaatacggaaatcagaagccgtctgatgccgattaacaaagcctataagcttcctgaccttatggaggccgtcaaatattacatcgagaaaacaggcagacggatcagctttgaatacgggctgttcggcggcgtaaatgatcaggtcgaacatgcagaagagcttgcagaactgttaaaagacgtgaaatgccatgtcaatttaattccggtaaactatgtgcctgaacgggattacgtccgcacaccgagagatcagattttcgcattcgaaaaaacgttaaaatcccgcggtgtaaatgtcacgatcagaagagagcaaggccatgacattgacgcggcctgcggtcagcttcgcgcgaaggagcgtcaagacgagacgaggtgaagaggttgattacagccttgaaaacagatacaggtaaagtccgccggcataatgaagatgcggcgggcattttcacaaaagaagacgcggtgcttgcggttgtcgccgacggcatgggcggtcatcttgccggagatgtagcgagcaggatggcggttgcggcgatggaagagcagtggaaccggaccgaaacggttccttctctgccgtccgcttgcgaggattggctgaaagaccggattcatgaggcgaatgtcaaagtgcatgaccacgctaaagccaatgaagaatgccggggaatgggcaccaccattgtctgcgccttattcacggggaagtttgtcactgtggctcatattggtgacagccggtgctacctgcttcaagagggggaattcactcagctgactgaggaccattcgcttgtgaatgagctggtcaagacgggggagatttcgaaagaggacgccgagcaccatccgcggaaaaatgtattgacgagagcgctggggacagatgaaaccatcagccccgacgcccgttcttttgaactgtctgacggcgatcagctgcttttatgctctgacggactgtcaaataaaatagaagatcacgagatcaaacaaatgcttcaagccgaatctgatcatcaggaaaaagtagaccttctcatcagcaaagcaaatcaaaacggcggcgaagataacatcacggctgtgttgattgagttttccgcagatgcaaaagagggtgaagacaagtgctaaccggcaagcggatcagcgggcgttatcatatcctccggcccattggcggcggcggaatggcaaacgtttttttagctgaggacatcattctcgaacgtgaagtcgcaattaaaattctgcggtttgactttgtgaatgacattgattttatcaggcgtttcagaagagaagcacagtcggcatcaagcctcgatcatccgaatatcgtcagtatttacgatatcggggaggaaggcgatatttattacattgtcatggaatatgtggaaggcatgacattaaaggaatacataaacgcacacggaccgcttcatccgaaagaagcgctgtccgttatggagcagatcgtctcggccatcgcccatgcccatcaaaaccatatcgtgcaccgggatattaaaccgcacaatatattgatagatcatttagggcatatcaaggtgacggatttcggcatcgccacagcgcttacgtctacgacaatcacacatacgaattctgtgctgggctcggttcattatttgtctccggagcaggcgagaggcggtctggcaacgaaaaaatcagatatttacgcgctcggcatcgtgctgtttgagcttttaacaggcaaaatcccttttgacggagaatcagccgtcagcatagcgctaaagcacctgcaaacagaaacgccttccgccagaaagtggaacccttccattccgcagagcgttgaaaacattattttaaaggcaaccgccaaagacccgtttcaccgctatgaaagcgccgaggacatggaggcggacatcagaacggcttttgacgccggcaggctgaatgaacaaaaattttccgtgcaggatgatgaggaaatgacaaaagccattcccgttattactgacggcccaaaagccgcgtctcaggcggaaacgccgggggagacggatgataaggaacagcagccagccaaaaagaaaaaacggaaatggccgtgggttttgctggccgtctgtttcatttttattatggcggctgttcttgcggtcaccgtgttcccgtctttatttatgcctaaagatgtaagcgtccccgacgtacggggcatgaagtacgaaaaagcggaagccctgcttgaaaagaacgggctccgggctgatcctgatataacggatattgaagatgaaaaaatagaagaggaattaatggtcaaaacggacccaaaagcggggtctaccgttaaagaaggctcttctgtaaaactgtacaaaagcatcggaaaaccgaaaacccagctgatcgacgtgaaaggacggcagatcggcgacgcaaaaaaagcgctgaaggaaaaaggtttcaaacatgtcaatgtcaaagaagaaaacgatgacagcgaggccggcaccgtaattgatcaggacccgtcagccggcaccgatatggtcgcaagcgatgatgaagtcaatctaacggtcagcctcggcccggcggacgttacgctgagggacttaaagacttacagcaaagaagcggcttcagggtatcttgaagataacggcctgcagcttgttgaaaaacaagcccattcagatgacgtgccggaaggacaagtcatgaaacaagagccgtcagccggcactgcggttaagccgggaagtaatgttgaagtgacgttctcgctcggacctgaagaaaaaccggcgaaaacggtaaaagaaaaaatcagcattccttacgaacccgaacatgaaggggaagagcttgaagtgcaaatcgccatcgatgataaggaccacagcatctctgatacgtatgactcatttaaaataaaagagccgaccgaaaaaacaattgaactgaagattgatcagggacagaaggggtattatcaagtgatggtcgatcataaagtcgtcagctacaaaacgattgaatacccgaaagataatgactgataaggagggaccctatgcctgagggcaaaattataaaagcgttaagcggattctattatgtcttggatgaatcacaggacaagatcattcaatgcagaggccggggcattttcagaaaaaataaaataacgcccctggtcggcgattatgccgtttatcaggctgaaaatgataaagaaggctacctgctggaaatcaaagaacgaacaaatgagctcatcaggccgccgatttcaaatgtcgatcaggccgttctcgtcttttctgccgttcagccggcgttcagcacgtctttattggaccgttttctcgtccttgtggaagccaacggcattcacccgatcatctgcataaccaaaatggacttagctgcagacggggaatcgaaagaggcgatactttcttacgtgaaagactatcaggcgatcggttatgacgtatatgtgacgtcatcaaaagaaaacagcggcttaacaggcattgtgaaacacttcgaggacaaaacgacggtgtttgccggtcagtccggagtcggaaaatcttcgcttttaaatgcgatcagcccggagcttgagctgaaaacaaacgagatttccgcgcatttgggacgcggaaaacatacgacgcgccatgtggagctcattcatacatcaggcggtctggttgcggatactccggggttcagttcgcttgaatttaccggcattgaggaagaagagctgggcagcacgttccctgagatcagagaaataagcgcctcctgcaaattcagaggctgtctgcatcttaaggagccgaaatgcgcggtaaagcaagcggtggaagaaggagagattcagccgtaccgctacgagcattacaaagaatttatgcaggaaataaaagagagaaagccgaggtattaatatgattaaggttgcgccatcaattctttccgccgattttgcttcactgggcgaggaaattaaagacgtggaaaaaggaggggcggactatatccatattgatgtcatggatggccatttcgtccctaacattacaatcgggccgcttatcgttgaagccgtccgtccggtgactgatctgccgctggatgtccatcttatgattgaaaacccggaccgctacatcccggcattcgcaaaagccggtgcggacatcctttccgttcacgctgaagcgtgtccgcatcttcaccggaccattcaattgataaaagagcagggggtaaaagcgggagttgtgcttaatccgcatacgcccgtccaaatgattgaacatgtgatcgaggagcttgaccttgtgctgttaatgacggttaaccccggttttggcggacagcgcttcattcattcggttctgccgaaaatccgtcaggtcaaacagctggctgaggagaaaggcctgtctgagcttttaatcgaggtggacggaggcgttaataaagaaacagcccctttatgcgctgaagcgggcgccaatctgcttgttgccgggtctgccgtatataatcagccggatcggaaaaaagccatcgctgacatccgaaacgcatcataaacatgctgaaaaagagcccggtgaaagccgccggctcttttcgcgtctaagagagaggatagcatatgaagacaatcaatatcgttgcgggcggcccgcgggagcttattcccgatctatccgaatacacagacggagatacgacgtgggtcggagttgataaagggacggttgctcttttggaggccggaatcattccgcaggaagctttcggtgattttgacagcattacggaagaggagctcatgcagattcaaaaagcggcgccggccctccatgtgtatcaggcggaaaaagattataccgatcttgaactcgcccttgactgggctttacaaaaagaaccggaaaacattcgggtattcggtgtgacgggcggaagagccgatcactttttagggaacatccagctgctgtataaagccttacataagcataccgatgtcaagctgatcgaccggcagaatgacattcagatgttcgggcccggccgttatacaattgaagaaaaagcgcgcagacgctatatttctttcattccgtttacggaagcggcagacggcctgacactcgacggttttaaatatccccttgataattgtcatattcctctgggttccacactatgtattagtaacgaactcattcattcacgaggtactttttcgtttgcaaaaggcatattaataatggtaaggagcgcggattagaaaagcggcttctgccatatgcggaaaaaaccatgaatcctaaagtgatgaacgcagcggatacgggacttataggaggggacaaaatgaaattttataccattaaattgccgaagtttttaggaggaattgtccgggcgatgctgggctcatttagaaaagagtaagcccaagaagctgaaatcgccctctttgaacgcataaaaaacgcctgccgcataaaagggcaggcgttcatttttgcttatacacgctcaactttaccggattttaaagcccgggcagatacatacacttttttaggtttgccgtcaacgaggatgcggaccttttgaaggttggcgccccaagtacgcttagaagcgttcattgcgtgagaacggttgtttccggcttttgtttttttacctgtaataaaacatttacgtgccatttgtttccctcctaactgcgcgaaacatctttttaaacatagtgtctcagatgctttcgttatacaatactttaaataatttaccacagctaaaaaccgtttgcaactattgtttcccttactttcaagaaaaatcacttgacatgtaaaaccaatcacatttccgcgctgaaggccgctgtctgtatcttttcttttcataatgggatacatatagtagaataatgataactctatgcacctgaaggaggaacctgtgtgtccattgaaatgaagacaaaatacggacagattgatatatccaacgaagtcatcgcaatggttgccggaggcgctgccattgactgttacggaatagtggggatggcctcaaaaaaccagattaaagacggtttgtctgaaatcctccggagagagaacttcgcaaaaggcgtacatgtccgtcaggaagccgaacaaatacatatcgacatgtacattattgtcagctacggcactaaaatatccgaagtagcccacaatgttcagacgaaggtaaaatacacagtaaatcaaacaatcggacttgcagttgattctgtaaatatttatgtccaaggcgtacgagtaacgaacccgtagtgaggaggatgagtattgtctagacgaaacttagatgggagagcttttgcggcaatgattctggcgggggctgagacattgtctcaaaacgcatccgcggtggatgcgctgaacgtgtttcccgtgcctgacggcgataccggaacaaatatgaatttatcgatgtcatccggtgcaagagaggtagagcacattgactcacccgacatcggcaaagtcggcatcgccctgtcaaaaggcctgcttatgggagcgagaggaaactcaggggtgatcttgtcccaattgttcagaggtttcacaaagagcattgaaaacaaaaaccaaattgatgcccaagagtttgccgcagcactccaagcgggagtggatatggcatataaggcggttatgaaaccggttgaaggaacgattttaaccgtggccaaggatgcggctaaaaaagcggtcgcctcggccaaagaagaaaccgatattatttcagtcatggaggccgttattgaagaagcggaagcgtcgctcaaccgcacgccggatctgcttcctgttttaaaggacgtcggtgtcgttgacagcggcggaaaaggtctgctttgtgtatatgaaggctttttggctgctttaaaaggagaggccgtaccgaaaaaagcggttcttccggcactcgatgatatggtgaatgccgagcatcataaaagcgcgcagagcatgctgagtacagaagacattgaattcggattttgtacggaagtaatggtgaggctggatcaagataaacggacgttcaaggaagaggcgttcagaaacgaactgagccgtttcggcgattcattgctggtcgtggctgatgatacgctggcgaaagttcatattcatgccgaagaacctgggaacgtactcaatctcgcacagcgttacggcgatctgattaaaattaaaattgaaaacatgagggaacagcatacttcaatcatcagccaagaacatgatgaaaaaaagccggccggcgttatgaaagaagcccgcaagccttttggcatcgtgactgtggcaatgggagagggcatttctgaattgtttacgagcatcggcgcttcacacgtaatcgaaggcggccagacaatgaatccgagcacggaagatattgttgaagccgttcagtctgtcaatgcggagacggttttcattcttccgaacaattccaatattgtgatggctgccaatcaggcggcgagcgtagctgaagaaaatgtcattgtcattccggcaaaaacggtccctcaaggcatgaccgccctgcttgcgtttaaccctgaccagccggctgatgtaaatgaagccaatatgcttgaggccatccggaatgtgaaaagcggacaggtgacatattcagtcagagacacccatattgacggcaaagaaattaaaaaaggtgattttatcggcattttaaacagttcaattatcggcagcgccgaagatcggataagtgcggcgaaattgctgctggatgaaatgatcggggaagaagatgaaatcgtcaccatcctgtacggagaggacgcgccggaagaagaagctgagaaactcgctgagtatattgctagcgtctgtgaagatatcgaggttgaaatccataacggcagacagcctctgtatccatatatatttgcggcagaatagaagggcttatcaggcccttctattcttatgcctttatttacctgcggcagtgcggcagtgtgcctgcttgccaattgagaaatgttcaattagtctaaagaaaagcgctgaatgaagtgatgttaaggaggagcaaaccagcatgaagtatagaagcgtttttgatattatcggcccggtcatgatcggtccgtccagttcacataccgcaggcgccgcccggatcggcagagtggccagaagcttattcaggcgtgagccccgccggatcgttgtgtctttttacggatcatttgcagaaacgtataagggtcacggcactgatgtcgcgattatcggcggcctgcttgattttgatacatttgatgaacggattaaaacagcgattcaaattgcggaagagaagggcatatatgtagagttccgtacagaggatgccgtgcccgttcatccgaatacggcgcgtatcgtcatttctgatgatgagggagagcttgcccttaccggtatttccatcggcggcggaaaaatagaaatcacggagcttaacggctttgagctgcgactttccggaaaccacccggctattttagtcgttcacaatgataaattcggcacgattgcaggcgttgccaatgtgcttgcgaaattctccatcaacgtcggacatatggaagtggcgcgtaaggacgtcggccagcttgcgctgatgacgattgaggtcgatcagaatattgaagaagaagtgcttgacgagctttcaacacttcctaatattatacaggttactaagatagctgactaaaaagtcaggaggaaaatgacatgtttcgtaatgtaaaagaattaatagaaatcactcaagaaaaacaaattccgatttcggaagtgatgatcacccaagagatggaagtgacgcaaaaaacacgagaagaaatctttcaaggaatggagcgcaatctctccgtcatggaagcagctgttgaaaaagggctgaagggcgtcacgagtcagaccggtttaacaggcggagatgccgtgaaacttcaggcatacatccaatcgggaagaagcctttcgggcaatctgattttagacgccgtttctaaagctgtggcgacaaatgaagtcaatgcggcgatgggaacgatctgcgctacaccgaccgccggctctgccggggttgtgccgggaacgttattcgccgtaaagcataagctgaaccctacgacagaacaaatgatccgttttctgtttacagccggcgcgttcggttttgtcgtagcaaataatgcgagtatttcaggagcggcaggaggctgtcaggcggaagtcgggtcagcatcaggcatggcagcggccgcgattgtggaaatggcgggcggaacgcctcagcaatcagcggaagcaatggcgattacactgaaaaatatgctcggtctcgtatgtgacccggtcgccggattggtagaagtgccgtgtgtcaaacgaaacgcaatgggagcatccaacgcgatgatcgcggcggatatggcgctggccgggattacaagccgcattccttgcgatgaggtgattgacgcgatgtacaaaatcggccagacaatgccgacagcactgcgtgaaacgggacaaggcggtttagctgcgacaccgacgggaagagaattagagaaaaaaattttcggaggagcgctgaaatcaagtgacacaccatcagcaaactagtatagcggaaattaagggcattgggccggaaacagaaaaaacattgcacgaacttggtatctatgacatttctgatcttctgaattatttcccttaccgttatgacgactatgagctgagggatttagaagaagtaaaacatgaagaaagagtgacggtagaagggaaggttcattcagaaccttctcttacctattacggcaaaaaacgaaacaggctgacattcagggtgcttgtcggcaattatttaattaccgcggtctgctttaaccgtccctacttaaaaaagaaactgacgttaggttctgtcgtcacgatatccgggaaatgggataaacacagacagaccgtttccgtgcaggaattaaaaaacggtcctcatcaagaagataaaagcattgagcctgtttattccgttaaagaaaacgtcaccgtaaaaatgatgagacggtttattaaggaagcgctgcagcatcatttggacagtgcggccgatccgcttcctgaaaaattgagaatccgctataagctgcctgattacaaacatgccctgcagacgatgcatcagcctgaaacgagggaatcgttacagcaggcaagacgacggtttgtttatgaggaattcttattatttcagctgaaaatgcaggcgttccgtaaagcggaaagggaacagtcaaaaggcatcagccatgtgtttcctgctgaaaagctcaccgctttcacagacagcctgccgttttcgctcacgaccgcacagacgcgcgtgcttcgggaaattaccgctgatatgacatccccttaccgaatgaaccgtctgctgcaaggtgatgtcggttcagggaaaacggccgtcgccgccatcgctttgtacgctgcgattctgtcggggcatcagggggcattaatggtgccgactgaaattctggccgaacagcatgcagattctctcgtatcgttgtttgcaaatgaagatgtaaatatcgcgcttttgacgagttctgtaaaaggaaagcggcgcagggagcttttggagcggcttgctctcggagagattgatattttagtagggacccatgctttaatccaggatgaagtggaattcaaagcgctgagtcttgttattacggacgagcagcaccggttcggggtcgaacagcgcaaaaaactcaagaataaaggtcaagatccggatgtgctgtttatgacagccaccccgataccgagaacgttggccattaccgtcttcggagaaatggatgtttccgtgatagatgaaatgcccgcggggcgaaaacaaatcgaaacgtattgggtgaaacacgacatgctggagcggattttggcttttatagaaaaagagctgaagcagggaaggcaagcctatattatctgcccgctcattgaagagtcggataaactggatgtacagaatgcgattgacgtatataacatgctgtctgacgtttaccgcggtaaatggaatgtcggcctgatgcacgggaagctccattctgatgaaaaagatcaagtgatgagagaattcagcgccaatcaatgtcaggtacttgtgtcaacaaccgtcgtagaagtcggggtgaacgtgccgaatgcgacgattatggtcatctatgacgccgaccgtttcggattatctcagctccatcagctccgcggccgggtcgggcggggagaccaccaatctttctgcatcttgatggccgatccgaaatccgaaaccgggaaggaacggatgagaatcatgtcagagacaaacgacggcttcgagctgtctgaaaaggaccttgaactgcgcggccccggtgatttcttcggaaaaaaacagagcggtatgcccgagttcaaggtggcggatatggttcatgactacagagctttggaaacggcccgccaggatgcggccaatctggtgtcttcagaggctttttggaaagatgacgaataccgcatgctgcgcggtcaattactttcaagcggcgtcctagaaggggagaaattaagctgattctgtaaaattcggcggctttcaaaaaacaatcattgcattccaatctatgagattatatactactattagtacctagtcttaattgtccggatggtgtttacagatgagaagaagcaagaaagaacgccaaaaattattgcagcagacgatcaaatcgacacccttcatcacagatgaagaattagcggggaaattcggcgtcagcattcagacgatccgtttagaccgcttagagctctcaataccggagctgagggaaagaattaaaaacgtggcagaacaaacgcttgatgatgaagtgaaatcattgtctttagacgaagtgatcggtgaaatcattgatctggagcttgacggccaggccatttccatattagaagtaagacgcgaacatgtcttcagccgcaatcaaattgcgcgggggcatcatttgtttgcgcaggcgaactcactcgccgtagccgtcattgatgatgagctggcgctgaccgcaagcgcaaatatccgctttacaagacaggtgaaagaaggcgagcgcgtcgttgcgaaagccaaagtgacggcagtcgaaaaagaaaaaggcagaacggtagttgaagtcaacagctatgtgggagaagaagtcgtgttctccggcagctttgacatgtaccgttcaaaacaatcataaaggtggagcatgcatgagaatagctgtagatgcaatgggaggcgacaacgcacccaaagctgttattgacggagtaatgaagagtattgaggcatttgacgatcttcatattacgctggtcggtgacaagacaacgatagaatcacacttgccaacaacatcagaccgcatcactgtgttgcacgccgatgaagtgattgaaccgacggatgaaccggtccgcgccgtacgcagaaagaaaaactcttctatggtgctgatggcgcaggaagtggctgaaaacagagcggacgcctgcatctcagcggggaatacgggcgcactcatgacagcgggactgtttatcgtcggcagaattaaaggaatcgaccggcctgcgcttgcgccgacgcttccgaccgtttcaggcgacggtttccttcttttggacgtgggagccaatgtcgatgccaaaccggagcatctcgtccagtacggaattatgggatctgtttatgcccggcaggttctcggaatcagctcgccccgcgtcggattgttaaatgtcggcacggaagaaaagaaaggaaacgacctgacaaaaaagacgtttgaattattaaaagaaacaaacgtgaattttgtcggaaacgttgaggcgagagacttgctcgaaggcgctgctgacgtcatcgtcacagacggctttacgggcaacgtcacgttgaaaacattggaaggttcagcgttatcgattttcaaaatgctgaaagatacactgacttcaagttttgtttctaagcttgcagcgggcgtgctaaagccgaagctgatggaaatgaaactgaaaatggactattctgagtacggcggggcgagtcttttcggtttgaaagcgcccgtcattaaagcgcacggctcttctgacgcacgcgctgtttaccatgcgctgcgccaggcgagagaaatggtcagccaaaacgtggccgcatttatagaagaagaagtaaaagaagaaaaaacagatgagtagtctggaggttaccgcatcatgagtaagattgcatttttatttcccggacagggatcacaatatatcggcatgggaaaagacctgtacgaacgcgaagaagcgtcaaaacgtatttttgatgaagcggatgaaacgcttgaaacaaagctgagctcgctcatttttgaaggtgacgccgaagaattgacccttacatacaatgcgcagcctgcgctgttgacaacgagcatcgccgtattggaaaagtttaaagaatccggcatcacccctgatttcaccgccggccacagcctcggagaatattcggcgcttgttgcggcgggagcgatgacatttaaagatgccgtttacacggtaagaaaacggggagaattcatgaatgaagccgtgccggccggagaaggcgccatggcagcgattctcggaatggatgcggagtccttgaaaaaggtgacggatcaagtgacggaaaacggtcatctcgtacagcttgcaaatctgaactgccccggccagatcgtcatttccggaacggcaaaaggcgtggagctggcttcagaggaagcgaaaaacaacggagcaaaacgggcgatcccattagaagtaagcggaccgttccattctgaattaatgaagccggcagcgcaaaaactcgaggaggtgctcagcgcctgtgagttaaaaaatgcggctgttcccgtgatttcaaacgtttcggctgacgttatgacggaaaaagacgatatcaagaaaaaactgatcgaacagctgtattcgcctgttcgctttgaagaaaccattaacaaactgattgacgaaggcgtcacgacgtttgttgaaatcgggcccggaaaagtgctttcaggccttgtgaaaaaagtgaaccgccgccttaaaacaatctcggtttctgaccatgaaaccatcgaactggcgattcaaacgctgaaggaggagaatcaggatgcttaatgaaaaaacagcagtggtaacgggagcgtcccgcggaatcggtcgggcgatcgcgcttgatcttgcgaaaaacggctgtaatgtagtagtcaactactccgggaatgaagcgaaagcgaacgaagtcgtagatgagatcaaatctttgggccgaaacgcgatcgccgtaaaagccgatgtatcaaattccgaagaagtacaaaacatgatgaaagaggctgtcgctgcattttcttcaatcgacattctcgtgaacaatgcggggatcacaaaagacaatcttctgatgagaatgaaagaaaatgaatgggatgatgtcattaacattaacttaaaaggtgtattcaactgcacgaaagccgttacaagacagatgatgaaacagcgctccggccggattatcaacgtatcatcaatcgtcggcgtcagcggaaaccccggccaggcaaactatgtggcggcaaaagccggtgtaatcggcttaacgaagtcatcagccaaagagcttgcgagccgaaatattacggtcaatgccattgctccgggctttatttccacggatatgacggacaagctttctaaagaagtccaagatgaaatgctgaagcagattccgctcgcgcgtttcggtgatccttccgatatcagcagcgttgttacgttccttgcttctgaaggatcgcgttatatgacgggccaaacccttcatattgacggcggaatggtgatgtaaagatttgtttttaaaatttcatcctagtttctctagttttttaaaaacgaatcctctataatacttgaggggaggtgaattgctatggcagatacattagagcgtgtaacgaaaatcatcgtagaccgccttggcgttgatgaagctgacgtcaaacttgaagcttctttcaaggaagacttaggtgctgattccctagatgtagttgagcttgttatggaacttgaagacgagtttgatatggagatttctgacgaagatgctgaaaagattgcaacagtcggcgacgctgtgaactacatacaaaaccagcaataagctgatgctaaaagtcccgcctgacagcggggctttagccctttaatcgttcggttaccggcgtctgacgctgtacgcgctgctgattccgtttacggcggggagcgcggtgaacctgatgtgcctatggaggttactatgtcaaaacactcacattttaaagataaaaaaaagttctataaaaaaatagagcaatttaaagagttccaagaacggatttcggttcattttcaaaacgagaaacttttgtatcaagcatttacacattcatcttatgtgaatgagcatcggaaaaagccgtatgaagacaacgaaaggcttgaatttttaggtgacgctgttttggaactgacgatctcccaattcttatttgccaaatatccggccatgagtgaaggagatttgacgaagctgagagccgctatcgtatgcgagccgtcactcgtctcacttgcccacgaattgtcattcggcgatcttgttctcttgggaaaaggagaagaaatgacgggcggcagaaagcgtcctgcgcttttagcggatgtgtttgaagcgtttatcggcgcactgtatctggatcagggccttgagccggttcagcaattcctgaaagagtacgtgttccctaaaataaacgatggtgctttttctcatgtgatggatttcaaaagccagcttcaagaatttgtacagcgggacggaaaaggatcgcttgagtacaaaattctcaatgaaaaagggcctgcccacaaccgggaattcgaggcgctcgtctctcttaaaggtgaggcgctcggtatcgggaacggacgttccaaaaaagaagccgagcagcatgcggcacaggaagctcttgcaaaattgcaaaaacatcatacgaaacaataaaatccccctgtatccctagggggatttcagtatgtctgcgcctgatataagcgggtgattatgataatattgagatacttatacgataaggaggatctgggatgttcctcaaacgtttagacgttataggatttaaatcatttgcagaacggatatccgttgactttgtaaaaggcgtcacggccgttgtcggtccgaacggcagcggaaagagcaacattaccgaagccatccgctgggtgctcggcgaacaatcagcccgctcgcttcggggcggaaaaatggaagatatcatttttgcgggaagtgattcgcgcaagcggctgaaccttgccgaagtcacgttaacgcttgataatgaagatcattttctcccgatcgattatcacgaagtcagcgtgacgaggcgggtgtaccgttccggagaaagtgaatttctcatcaacaatcagcagtgccgcctgaaagacatcattgacttatttatggactccgggctcggaaaagaagcgttctccattatcagccaggggaaagtcgaagagattctcagcagcaaagcggaagaccgccgcagtatttttgaagaagcggccggcgtgctgaaatataaaacacgaaagaaaaaagcggaaaacaaactgtttgagacgcaggataacttaaacagggtggaagatattctccacgagcttgaagatcaggtcgaaccgctgaaaatccaggcatcaatcgccaaagactacttagaaaaaaagaaagagcttgagcatgtcgaaatcgcccttaccgcctttgacatcgaacaactgcatagcagatggtcgggtttaaaagaaaaggtgcagacggcaaaacaagaagaattggcggaatcatcagctctgtccgcaaaagaagcgatgatagaagagacgagagataaaatccacgcgcttgatgaatccgtcaacgaactgcagcaggtgctgctcgtgacaagtgaagagctggaaaagctggaaggccggaaagaagtgctgaaagagcgcaaaaaaaacgccgcgcaaaaccgggaacagctagaggaatccgttacacattacacgaacaaagaagccgaactgaaagcggacattgaaaaacagtctgccgtctatgataaacttcgtgcggaagtgaagcggttaaacgcccaggtgaaagaaaagcagcaggctctcagtctgcataatgaaaatgtagaagagaaaatcgaacaattaaaaagcgattactttgaattgttaaacagccaggcgtcgattcgcaacgagctgcagcttttagatgatcagatgtcccaatctgcggtccagcaggcgagactgaccgcaaacaatgaaaaataccttgaagaacgtaacgatattgcagtccgcaaagcggcgtgcgaagaggaattggccgccgttgaagaggatattcacaatcaggtcgtccgctttcgcgaagtccagacagcatatgaacagaaaaaacgccagtatgaaaagaaagaatcagcgctgtatcaggcatatcaattcgtccagcaggccagatccaaaaaagatatgcttgaaacgatgcaaggcgatttttcaggattttaccaaggcgtaaaagaagtgctgaagcagaaagagcagctcggcggcatccgcggcgccgttctcgaactgattgcgaccgaacaaaaatatgaaacggcgattgagattgcactcggcgcagcggcgcagcacgttgtcacagacgatgagcaggcggcgcggaaagcgattcaatatttaaaacagaattccttcggccgcgcgacgttcctgccgcttacagttatgaaaccgcgccagcttcaaacccgtgatgaacagacggcttcaaagcatccgtctttcctcggcacagcgagcgggcttgtcacatatgatgcggcgtatcggaatgtcattcaaaaccttctcggcaccgtgctgatcactgaagatttaaaaggcgcgaatgaactggccaagcttctcgggcaccgctaccgcatcgtcacgcttgagggcgatgtcgtcaatccaggcggatcaatgacaggcggcgcggtcaaaaagaaaaacaattctctgctcggcagaagccgcgagcttgagacggtgactgcgcggcttgccgaaatggaagaaaaaacagctctgctcgaaaaagaggtcaaagcgctgaagcaggccattcaagagcttgaacatacgctgagcggtctccgtgaagacggtgaggctttcagaacaaagcagcaggatgtaaaaggcaggctgtatgaactcgaagttgctgaaaagaacatcaatacccatctggagctttacgaccaggagaaagcatcactgacggaaagcagccgggaaaaagagacgcgcaaatcagctctggaagaacagctgagtgaggcatccggccagctgaaagagcttgaggaagagatggaaaggctgacaaaacaaaagcagaccctatcctcaacaaaagaaacgctctctcatgaactgacggaatgtaaagtggccgctgcgaaaaaagaacaggcgtgctcgagtgaggaagacaacctcaaaaggctgaaaaaagagcttgaagaaacgcagctcgctctgaaagaaacacgggaagatttaagcctcctgacctcagagatgacgtccagcacaagcggtgaggagcagcttgaagaagcagcccatcataagcttcacgataaaacgagaacgatcgaattgatcgccagccggcgcgaccagcgtgtgaagctccagcgggctcttgatacgaacgagcttgagctgaaagagatgaagcgtctgtacaagcaaaaaacggacattctgaaagatgaagaggtaaaactcggccggatggaagttgagcttgataatctcttgcagtatttacgcgaggagtacagcttatcctttgaaggggcaaaagaacaatatcagcttgaactcgagcctgaagaggcgagaaaacgggtcaaactgatcaagctttcaattgaagagctcggaacggtcaatctcggcagcatcgatgagtttgaaagagtaaacgaacggtatcagtttttaacagagcagaaaaatgacctgacggaagcgaaaaacacactgtttcaagtcattgaagaaatggattctgaaatgacgaagcgattccatgaaacgtttatccagatccgttctcaattcaacgacgtgttccgttctttattcggaggaggacgggctgaactgaagctgactgatccgaatgatcttcttaattccggggtggacattatcgcgcagcctccgggcaaaaaactgcaaaacttaaatcttttgtcagggggagaacgggcgctgactgccattgcccttttattctctattctgaaagtaaggcccgtgccgttctgcgtccttgatgaagtggaagctgcgcttgatgaagccaatgtattcaggtttgcgcaatatttaaaaaaatacagcggcgacagccagtttatcgtcatcacccacagaaaaggcaccatggaagaagcggatgtcctctacggtgttacgatgcaggaatccggcgtttcccgaatggtttcggtcaaactggaagaaacaaaagaatttattcagtaacgaggaaagaggttgaaagatgagcttttttaaaaaattaaaagagaaaatcacgaaacagacagactccgtctctgaaaaatttaaagatggtcttgaaaaaacaagaaattccttctcaaataaagtgaacgaactcgtctcccgctaccggaaagtcgacgaggatttcttcgaggagcttgaggaagtgctgattggcgctgacgtaggttttacaaccgtcatggagctgattgatgagctcaaaaaagaagtgaagctgaaaaacattcaggatcctcaggaagtgcagtccgtcatttctgaaaagcttgtcgacatttataacagcggcgacgaacagatttctgaattaaatattcaggacgggcgcctgaacgttattctgcttgtcggggtaaacggcgtcggaaaaacgacaacgatcggaaaacttgcccataagctgaagaatgaaggcaaatccgttgtgctcgctgccggagacactttcagagccggggcgattgaacagcttgaagtgtggggggagcgtacaggcgtgcctgtcattaagcaggctgccggaagcgaccctgcggcggttatttatgatgccgtacacgcggctaaagcaagaggagcggatgtgctgatttgtgatacggccggccgccttcagaataaagttaacttaatgaaagagcttgaaaaggtcaaacgcgtcattgaacgcgaagtgcctgaggccccgcatgaggttctccttgcgctggacgcgacgacaggccagaatgcgatggcgcaggcgaaagaattctccaaagcgacgaatgtgacgggtatcgcattaacgaagcttgacggcaccgcaaaaggcggtatcgtcctggcgatccgcaatgagcttcacatccctgtgaaactggtcggcctcggagaaaaggttgacgatctccagcggtttgatgcagaatcttacgtatacggtctcttttcggatttagttgaaaaagccgaagattaatgaataaaaaacgagtataaaatggacggttttatactcgtttttttatacgcattgatagatcggaatggaggggcagttgttggacaaatggctgaaagctgaattggaaagtaagatcggcgcgataaaccatatgtcgctgctggatgaacagggaggcacttcaaccgttcgaaaaatagtgaccggtcaagacgcatttttgctgaaaagttcttttcaacagaagtatcgggaatggttaatgagagaagccttcgttttacaacaactgacggaaactcgtcgtctgcctgttcctatttactatgggatgatacaggaacagcatgccagccatatcatcatgtcatttgaggatggaatcaccctgacttcggctttaagaaaagccaaaggggatactgaaaagaaaaagctgatcaaaagtttcggccagtttctgcagcggctgcatgaaaccgaaatggtctctggtttacagccggaaacagactggctcgatctgcaaatcaaacgagccggggaatatgtcaaaaaaggacaagctgaaggaagtgcagagcttttgaaggaattggacaggtacaggcctgttcctgttcagcagacaatgattcacggtgactgcacgactgataatgtgctggtgagagacggagaggtctatctgtttatcgatgctgcgggaatatcggcgggagatccgcgttatgatgaatcattagcgatcagtcgttttgtcacaaatgaatcatgtctcaatgctttttacgaaggctattgccgctatcgtgtatcaaaacaagaattcgagtattttaacgacggtctgtatgaatttttttgaaaacacttattatgtaaaaagagcatcctgctttgacaagataaaaacttgacacacgctctgaaaccatgtaaactaagtttttgtaaagggatttgacttaacaaaggggagagctcaaatgtcgctcgaaaaaacgacgagaatgaactatttgtttgacttctatcagtcgttgctgacgtcaaaacaaaagagctatatgtcgctttattatctggacgatttctcccttggtgaaatagccgaagagtatgacgtttcaaggcaagccgtttacgataacatcaaacggactgaagcgatgcttgaacaatatgaagaaaaactgctcctttttaaaaagtttcaggagcgtaaagaaatgtttacaaagctgaaagagcttgcttccggcttgcaggaagaggaaaaaatgacggctctgattgaagcgcttgagaaattagattaggaggcggcaaacaatggcatttgaaggattagccgaccgactgcaaaagacgatttcaaaaatccgcggaaaaggaaaagtcagcgaacaagacgtaaaagagatgatgcgtgaagtccgtcttgcgcttcttgaggctgacgttaactttaaagtcgtaaaggattttgtgaaaaaagtaagtgaacgggctgtcgggcaggacgtcatgcagagtctgacacccggtcagcaggttattaaagtcgtaaaagaagagcttaccgagctgatgggcggcgaagaaagcaaaattgccgccgccaaacgcccgccgaccgttattatgatggtcgggctccaaggtgccggtaaaacgacaaccacggggaagcttgccaacctgctgcgcaaaaaacataaccgcaaaccgctgctcgtggctgcggatatttaccgccccgccgcgattaaacagctggaaacactggggaaacagcttgatatgccggtcttttcgcttggcgatcaggtcagcccggtggaaattgccagacaggcgattgaaaaagcgaaggaagagcatcatgattatgtgattttagataccgccggacggctgcacatcgatcatgaactgatggatgagctctccggcgtaaaggaagtcgcaaatcctgaggaaattttccttgtcgtcgactcaatgaccggtcaggatgcggtaaacgtcgccaaaagctttaatgaccagctcggtttaacgggcgtcattttaacaaagcttgacggggatacccgcggaggtgcggcgctttctatccgcgcggtcaccgaaacgccgattaaattcgccggaatgggagaaaagctcgatgctcttgaagcgttccatcctgaacggatggcatcccggattctcggaatgggtgacgtgctgacgctgattgaaaaagctcaggcgaccgttgatgaagacaaagccaaagagcttgagcagaaaatgagaacgatgagcttcacattggatgattttctggagcagctcggccaggtccgaaacatggggcctcttgacgaactgctgcaaatgatgcccggagcaggcaaaatgaaaggcttaaaaaacatccaagtcgatgaaaaacagctgaatcatgtggaagcgatcattaaatcaatgactgttcttgaaaaagaacagccggatattattaacgccagccggcggaagcggattgccaaaggaagcggaacatccgttcaggaagtcaaccgtcttttaaagcagtttgaggaaatgaaaaaaatgatgaagcagatgaccaacatgtcaaaagggaagaaaaaaggctttaaattaccttttatgtaatcggttatacatgataaaaccgttgttaagaaaaaacactttacaaacacttttatcattgttaatatactatcttgttgaaatattttcggaggtgctagtaaaatggcagtaaaaattcgtttaaaacgtatgggagcaaaaaaatctcctttctatcgtattgttgtagcagattctcgttcaccgcgtgacggccgtttcatcgaaacagtcggcacatacaacccggttgcaaagccggctgaagtgaaaatcaatgaagagcttgctcttaaatggcttcaaacaggagctaaaccttctgatacagtccgcaacttgttctcaagccaaggaattatggaaaaattccacaacgctaaacaaggcaagtaatgactgatcagaacttggaagatttgattgtcagcattgtggctccgcttgtcgaccatccggaagacataacggtcacaaaggaagagactgatcaaaagattgcgctacgcttatctgtcaataagtcggataccggtaagattatcggaaagcaaggccggactgcaagagcgattcgaaccgtcgtttttgcagctggcgcacagtcttctaagaaagttcaatttgaaatatttgactgaaaaagggagagggccggcacctcccctttttttacacgtaaaaaaggcaaatgaacagaaatatgttggaagagtggggagtctggtcctatgcagattattcacagggtaaccgttatgcaggttctgaccgagcaaagcaaggaaaagcttttggcctcttttgcagaaaaaaagcaaacgcttgaacgagaatgcagccagctctattttcagcttagaaaacatgaaaaagatcagcagaatcccgatgtagcggaatcttttaaaaaagccattgaaaaaagacaagataaaatcaaaatgattgatttccaaataagccagacagagtcgctcccgcttggaagcgaagtgaaggaaaaggagatcgatgcgctgctttcaatcaacgtcggtgataactggcatgaaaaaacagcggcaaataccatcgtcataaaagacggggtagtaattgaaatccgcccgaggtgataatatgacaaacagatggtttaatgtaggcaaaattgtaaatacccacggcattaaaggcgaagtgcgggtcatttctaaaacggactttgccgaagaacggtacaagcccggcaatacgctctatttgtttgcggaaggggctgcggagccaatcaaagtaacggtcagcgcccacaggcttcacaagcagtttcacctgctgcaattcaaagaaatgccgagtctcaatgaagtcgaacacctaagaaacatggtgatcaaagttcctgaagaagacttgggagagcttgaagaagatgaattttattttcatgaaatcatcggctgcgaggttgtgtcagaagacggggaactgatcggcacagtgaaggaaatcttgacgcccggggctaatgacgtatgggtggttgcaagaaaaggcaaaaaagatgcgctcattccgtatatagcttctgtggtgaaggatattaatataaatgagaagaaaattaagattcatgtaatggaagggttaatagacgaatgaaaatcgactttttaacactgtttcccgaaatgtttcaaggggtgctcggctcatccattctgcaaaaagcacaggaaaaagaggctgtccgttttgacgtcatcaatttccgggctttttcggataataaacaccaaacggttgatgattacccgtacggcgggggagccgggatggtgttaaagccgcagcccgtatttgatgcggttgaaaagctgacagccggtacggacgccaagccgcgcattattctcgtctgcccgcaaggtgagcgttatacgcagaagaaagccgaggagctggcggaagaggaacatctcatgtttatttgcgggcattatgaagggtatgatgaacggatccgggaacatcttgtcactgatgaaatctccatcggggattttgtgctgaccgggggagagctccctgccatgatgattgccgacagcgttgtcaggcttttgccgggcgtcctcggaaaagaagcatcccacgtggaggattccttcagcacggggcttttagagcatcctcactatacgaggccagccgattataaaggcttaaaagtgcctgagacccttttgtccggcaaccatgccaaaatacaagaatggcgcaataaagaatcaatcagaagaacctttttaagacgtccggatcttcttgaaaactatcctctcactgatgagcaaagaaaatggatttccgagtgggaaaacgaatagattctattgcgcaggtgatgaagatatgataagatactacttgtggcttaaggaggcttatccttcagaagcttgaaaacgatgttccgctgtgccttgcagttgtggccaagagcatctgttggaaggagttgaaaacgatgcaaaaactaattcaagatatcacaaaagaacagcttcgcactgatcttcctgcgttccgtcctggtgacactttacgtgtacacgtaaaagttgttgagggtaaccgtgagcgtatccagatcttcgaaggtgttgtgatcaagcgtcgtggtggtggaatcagcgaaacgttcacagttcgtaagatttcttacggtgttggcgttgaacgtacattccctgtacacacaccaaaaatcgcgaaaatcgaagttgtacgttacggtaaagtacgtcgcgctaagctttactacctgcgtgaacttcgcggaaaagcggctcgtattaaagaaatcagacgataatgataacgaacgaaaagagcttgttacccgtaacaggctctttttttatatgaaatttgtaaaagcggaacaagcaacgtaaaatacataagagatcatcggaacatccggttccggtaaataaggcaggtgtcgaagtcacatgaccattcaatggttcccgggccatatggctaaagcgagacgggaagtaacagaaaaactgaaattaattgatatcgtatacgaattggtggatgcgagaatcccgatgtcatcgagaaatccgatgattgaggagattttaaaaaataagccgcgcattatgcttttaaataaagccgataaggcggatgcggctgtgactgcccagtggaaggaccactttcaggaacagggcattccctctctttcaataaactccgttaacgggcagggactgcatcaaatcgtgccgtcctcgaaagagctgctgaaggataagttcgataaaatgaaagcaaaaggtgttaggccgagagcaatccgcgcattaatcatcggcattccgaatgtcggcaagtctacgctcattaaccggctggccaaaaaaaacattgccaagacgggagacaggcccggcattaccacttcacagcagtgggtaaaggtaggcaaggaattagagctgctcgatacaccgggaattttatggcctaaatttgaagatgagcttgtcggcttgcgcctggcgatcaccggggcgattaaagatacgattatcaacctgcaggatgtggctgttttcgggctgcgctttctggaagagcattatcccgaccgtttgaaggagcgctacggacttcaggaaatccctgaggatatcgccgctcttttcgacgcgatcggtgaaaaacgcggctgtttgatgggcggcggaatggttgactatgataaaacaacggaagttatcattcgggacatccggacggaaaaattcggcaggctttcatttgaagcaccatcagaataaagacgcgcagcgatgcgggtctttattttttccgcagaataccgatatacataatgtaagggagaagagaacgtgaatacattaaccgtaaaaagcgtaaaagaacgcctgcaagagatcagggacgaaagcgaccccttccttgcccaatgtgagaaagacccgagaaaaagcgtacagacgcttttagagcaatggctgaaaaagcatgcgaaggaaaaagctcttaaagagcaatggctggacatgacggcatacgaaagactgtcatccaaaaagggcttccgcctgattgcgggtgttgacgaagccggaagagggccgcttgccggaccggttgtcgccggcgccgtcattttgccggcagaatgcgagattctcggtctcacggactcgaagaaattgtcggaaaagaagctcgaggagtattacagccggatcacggaagaagcggcggctgtaggagtcggcattgtccatgcggacgtcattgaccggatcaacatttatgaggccgcgagactggcgatggtaaaagccgtcaatgctttaacggaaacacctgattatctgcttgttgatgccatgacccttccgcttgacattccgcagtcatcagttataaaaggggatgccaaaagcgtgtcaattgccgccggagcctgcatagcaaaagtaacgcgggaccgtctcatggctgagtacgccaaaacttaccccatgtacggctttgaaaaaaataaaggctacggaacgaaagaacatcttgaagctcttcaggcatacggaccgacaactattcaccgaaaaacgttcgctcccgttcaatcttattgttagaaaagaggcttaagacatgaacattagcggcgaaatccaagcggctttcagacagctgacggcggaaatccctccggaccggcaggacggcggtaaagacagcggtactcaaaggctgctgttagggaaggttctccgtttgctggacgatcaaagcgctcttatccagatcggcggccggacgatgcagggaaaacttgaaaccgcccttcgtccgcaggcgtattactggttttcttatgacaaacagccggcggaaaaaacgggccggcttcatgtcatcgaccaattcgaaggaagcccgaaaaccgttcaggaagcggcgggtagactgttaaacgctctttccgtcaaaccgggccctgtgtctctgcatattgccgaaacgtttatgcagcagaagctgccgatgacggaaaacagcctcaaagcctgcgtccgctgggctgaatcgcttccggccgccgaattgaaaaaagcggcggaaacaatcgtatttgcgctgaaacgggaactgcccgcacatccggaagtcttgtcagccattcatgccgttaaatatccggttccgacccggcgcctcctctcaggactgcttcaggcaatcaatcaggcaccgcaatcggcaaaagagctgtctgtgctcaaagaggcggtttctgacgtattaaacgcggaaacggatcttcatgcagaacgtctcttgaagaagcttgccgaggctgcacgcatgccgatcccagaaaccgggctgatggatgaagaagaacggacggaatcaaaacaatcaccatttgtccgagagactcgtgaaaacggaaaggcagtctcaagccaaccttctcctccgagtgcgcggacagatcaaaaacttcctgaaaaaacggcaaaacagattatagagaaattaatgacatcggcagaaaaaactgaaaaccgccccgtaaaagtaacggcggagatcattaaggctttcatttctcaagaaaaaacatttaaaacagcacctgttcttcaaaaagcacatctgacagaacaggaggcggctgttttcgaaaaagccgttcagctcaccgaattgaaatatgcggaaaaacatgatgtattaagccttttgcagaaaatcaaaaaaggattgggcacgcgtgatgaattatcattcattacagcgcttgaaaaaggcgtatctccgcagccggagaaacaagcgctgaaaacggccctccaagccgtccggacgcttcaagaagcgccccaatccgttaaacaagaggcggaaccgcttattcataaattaaacggccagctgtttattgagcagcataacccttcttttacgcagatggtgctgtcatttccgctgggagcgtccgcgtatgagaatgacatcacagttctctttaaaggacggaagaagccggacggaaaactcgatccgtcacattgcaggctcctgtttttgctgcatcttgaaacactgcaagaaaccgttgtggactgcgtgattcagcaaaatgtaatgaccattacggttgagactgattttgagcttcaggcggccatcgaccctctcgtaccggctttaaaagaagccgtaaaagaaacgggcttcagcctgtcaggcgtcacgtctaaaaaacggcgcccgaaagaccagagcgctcttgtggaagagtttatagaaaaagacggcggaagaaaagtggatgtgaaaatatgaaagagcaaacgccgttaagaagagctgtcgccctgcattacgaccggcagaaagaccaagccccgaaggttgtcgcaacaggcagggggcacgtggcggaaaatattataaaagaagctgagaaggctggggtccccattcaggaagacagaacccttgtcgaattaatgcgccatttgacggttgacgatcacataccggaggcgctctatgaaaccgttgccgaaattttttcatttgtttacagactggacaaaaccctgaaaaacgaaaaataaggaccattcatttcccggactccgtttaaatttatattttcaataaaataaaagttagaatgtttggaaggatataaagattttgttttgaaccctagacaattcttccagtattatatagaatgaaagcgcagtctatttttagttttgctacataagttaggaggatgggaaatgaatatccatgagtaccagggaaaagaagtcctcagaaaatacggggtgtctgttcctgaaggtaaagtggcttttacagcagaggaagcagttgaaaaagcagagagcctgtcaagctcggtttatgtcgtaaaggcgcaaatccatgctggcggccgcggcaaagctggtggggtaaagattgcaaaaacaaaagatgaagtgaaagagtatgccgaagaactgttaggcaagacgctcgtcacacatcaaacgggtccggacggacaagtaataaaacgcttacttattgaagaaggctgcgatattaaaaaggaatactatgtcgggcttgtacttgaccgcgctacttcaagaatcgttttaatggcgtctgaagaaggcggaacggagattgaagaagtagcggaaaaaacacctgaaaaaattaaaaaagcggtaattgatccggctgtcggccttcagggctatcaggcaagggaaattgcattcgcaattaacatcccgaaagagcttgtcggcaaagccgctaaatttatgctcggtttatataaagcatttgttgagaaggactgctccatcgccgagatcaaccctctcgtcgttacgggggacggaaacgtcatggcgctggatgctaagctgaacttcgacagcaatgcgttatacagacaaaaagacattatggaatacagagatttagatgaagaagatccgaaagaaatcgaagcgtcaaaatacgatttaagctacatttcccttgatggaaatatcggctgtatggtaaacggcgcgggtcttgcaatgtctacaatggatatcattaaacactacggcggagaacctgcaaacttccttgatgtcgggggcggcgcaaccgcagaaaaagtgacggaagcttttaaaatcattctttccgatcaaaacgtaaaaggaattttcgttaatattttcggaggcatcatgaagtgtgatgtcatcgccgagggcgttgttgaagcgacgagacaagtcggattgacattgccgctggtcgtgcgccttgaagggacaaacgtagatttaggaaagaaaatcctgaatgaatcaggcttaaacatcacatctgcggaatcaatggcagacggcgcacagaaaatcgtatccttagtttaggaaagaatgaaaggcaggggaccagataatgagtgtttttatcaataaagatacaagagttattgtacaggggattacaggttctaccgctttatttcatacaaagcagatgctggaatacggcacgaatatcgttggcggtgtaacacctggaaaaggcggaacggaagcggaaggcgtaccggtattcaatacggtcgcagaagcggttcatacaacgggcgctgatgcgtcagtcatttacgtgccggctccgtttgcggcggacgcaattatggaagcggttgacgcggaaattgatcttgtcatttgtatcactgagcacattccggttttggacatggtgaaagtgaagcgctttatggaaggcaagaaaacgagattaatagggccgaactgcccgggtgttattacacctgaagaatgcaagatcggcattatgccgggatacattcataaaaagggtcatgtaggcgttgtatcccgttcaggaacattgacatacgaggccgtccatcagctttcagaagccggcgtaggccagtctaccgctgtaggaatcggcggcgatccggtcaacggcacgaactttattgacgtgttaaaagcgttcaatgaagatcctgaaacacatgccgtcatcatgatcggagaaatcggcggcacagctgaagaagaagcggctgagtgggtgaaagcgaacatgacgaagcctgttgtcggctttatcggcggtaaaaccgcgcctccgggaaaacgcatgggccatgcgggcgccatcatctccggaggaaaaggcacggcagaagaaaaagtcaaaacgatgaacgcctgcggaattgaagtcgcggaaaccccttctgtaatgggtgaaacgctgattaaggtgttaaaagaaaaaggcttatttgaaacgtgcaaaacgcactgatcgaagcaggggcagccgtaacggctgttcctgtttttgctgaaaaaagaggaggttgccagatttggatcaagcatcgcgctgtttaatggtctgcagtattaatcaaatcatttccccgtctcttctattaaaatggtggaaagctgatcactctctgtcttttttttcggatccgcatccattaactgttttatcagaggggaaaacagccccggaagcaatttttcgggaaatagagcgcaaggatccggaacttgatgaagttctgtccgattaccgccgcgaaggcattactgttattccgatttcatcaagctgctacccaacatggcttaaagcgatttatgatccgccggctgtcttgtatgcaaaagggaacacaccgcttcttgaaaaaggcagaaaaatcgggattgtaggaacgcggaaaccgacggaagacggaataaaagcggctgggcatctttccgccgaactctcaaaaaaaggctgggtcattgtaagcgggcttgcatccggtatagacggtttgtctcataaggcgagcatcagggcaaaagggcttacgatcggcgtgatagccggcggattccatcacatctatccccgggaaaatctcctgttagcagaatacatggctgaacaccatctcctactctcagaacatcctcctgaaacaaagccgaaaaaatggcactttccgatgagaaaccgcataatcagcggactaagtgaaggaattgtggtcgtgcagggaaaagaaaaaagcggttcattaatcacagcttaccaggccctcgatcaaggcagagaggtatttgccgttccgggttccatatttaatccatattccggaggacctataaaactcattcaagaaggggcgaaagctgtattatgcgcagaggatattgacggagagctgaccgcccgatgcgttcagtatacggaacccttttgaaatatcgtttgacaaacggtattgtaatatttaataatagtgaggatttaaagttgcatattattttcatgtataaaatgacgttcatcataaagaatgaaatgttgaaagccataaaaaggcagctctaaaatgaattgatacttgaaaagagagagaacacctcttgagggggatgaaaatgtctgattatctagtcatcgtggaatcgccggcaaaggcgaaaacgattgaacgttatttagggaagaaatataaagtcaaagcttcaatgggacatgtccgggatcttccgaaaagtcaaatgggagttgacatcgaacagaactttgaaccgaaatatattacgatccgcggaaaaggccctgttttaaaagaattaaaaacagcggcaaagaaagcaaaaaaagtctatctcgcggccgaccccgacagagaaggagaagcgattgcatggcatctcgcacacagccttgatctggatctcagctcggactgccgggtcgtctttaatgaaataacgaaagacgccattaaagaatcatttaaacatccgcgcatgattaacatggatcttgtcgatgcgcagcaggcgcgccgcatactagacagactcgtcggatacaaaatcagcccgattctttggaaaaaagtaaaaaaaggcctcagtgcgggccgtgttcaatccgttgcgctccggctgatcatcgaccgggaaaaggaaatcaatgactttaaacctgaagagtactggacgattaccggctcatttttaaagggaaaagagacgtttgaagccggatttttcgggaaaaacggcaaaaagcttcctttaaaaagcgaagaagacgtaaaagccgtccttgctcagctgaaaggcaataagtatacagttgacaaggtgacgaaaaaagagcgcaaacgaaatcccgctctgccgtttacaacgtcaactctgcagcaggaggctgccaggaagctgaatttcagagcgaagaaaacgatgatgatcgctcagcaattatatgaaggaattgatctcggcaaagaagggacagtcggactcatcacgtatatgagaacggactcaacgcggatttccaatacagccgttgaagaggcgtcagcttttattgatcaggcatacggaaaagagtacttagcgggaaaacggaaaccggcaaagaaaaatgaaaacgctcaagatgcccacgaagcgatccgcccgacttcggtgctcagaaaacctgccgacttaaaagcggtgcttggaagagaccagctcagactatacaagctgatttgggagcgttttgttgcaagccagatggcgcctgccgtacttgatacgatgagcgtcgatctcagcaataacggattgacattccgggcaaacggaagtaaagtcaaattcgccggcttcatgaaagtctatgtagagggtaaagacgatcagctggaagaaaaagaccgcatgcttccggaccttaaagagggagacacggttttatcaaaagatattgagcctgagcagcactttactcagccgcctccgcgttacacagaggcgcgcctggttaaaacgcttgaagaactggggatcggccgtccttcgacatatgcgccgactcttgacaccatccagcgccgcggttacgtgggattagacaataaacggtttgtgccgactgagcttgggcagatcgtgctggatcttatcatggagtttttcccggaaatcatcaacgttgaattcacggctaaaatggaaagggaccttgaccatgttgaagatggcgagacagaatgggttcaaatcattgacagcttctataccgatttcgaaaaacgcgtgaaaaaagcggaagctgaaatgaaagaagtggaaattgaacctgaatacgcagatgaagattgtgaattatgcggctcccggatggtttataaaatgggccgatacggtaaatttatggcgtgttccaacttccctgactgccggaatacaaaaccgattgttaaacaaatcggcgtaaaatgtcctaagtgccatgaaggaaatattgtcgaacgaaaatcaaaaaagaaacgcgtcttttacggctgtgaccgttatcctgaatgcgacttcgtatcttgggacaaaccgattgaacgaaaatgcccgaaatgtgaaaatatgctcgtagagaaaaagcttaaaaaaggcatacaagtccaatgcgtcgaatgcgattataaggaagaaccacagaagtagcggtgagcagagccttgctcaccttctttgtgtggaagggacaaacaacaggagatgaaaagaaatgaaccagcaaacagttaatgtaatcggagcaggccttgccggaagtgaagcggcatggcagcttgcaaaacgaggaattcaagtaaaactatacgaaatgcggcccgtcaggcagacggcagcccatcatactgataaattcgctgaactggtatgcagcaactccctccgttcaaatacactcgccaatgcggtaggcgtattaaaagaagaaatgcgggcgcttgactcagcaatcattcaatctgctgataaatgctcggttccggcagggggagcgcttgccgttgaccgccatgaatttgcgcaaagcgtgacggatctcgtgaaaaaccatccgaacgtaacggttcttactgaggaagtaacagagattccggaaggcccgacggttatcgcgaccggaccgcttacatcagaatcgctttcacagcagctgaaagagctcacgggagaagagtatctgtatttttatgacgcggcggcgccgattgtcgaaaaagacagccttgatatggataaagtgtacttaaaatcccgttatgacaagggagaagcggcatacttaaactgcccgatgacagaggaagagtttgaccgtttctatgaagcattgacgacggctgagacggttcctttaaaagaattcgagaaagaaatcttctttgaaggctgcatgccgattgaagtcatggcgaaaagaggcaagaaaacgatgctgttcggaccgatgaaaccggtcggactggaagatccgaaaacaggcaagcgcccttatgcagtcgttcagctcagacaggatgacgcggcgggaacgctttataatattgtaggttttcagacacatttaaaatggggagatcaaaaagaagtgctgaaactgatccccggccttgaaaatgttgatatcgtcagatacggcgtcatgcacagaaacacatttatcaactcgccgagccttttgaacccgacatatcaatttaaacagcggaacgatctgtttttcgcgggccaaatgaccggtgtagagggttatgttgaatctgccgcttcaggtcttgtagcgggaatcaatgccgccaaacttgtgctcggtcaggatcttgtgacattcccgcaggagacggcgatcggaagcatggctcactacattacgacgacaaatcagaagaacttccagccgatgaatgcaaacttcggcctcttaaaagaattgcctgtaaaaattaaaaacaaaaaagaacgaaatgaagaatacgctaaacgcgcaattgagactattcaaactatttcgaaaacgatatagcttttcattgcaacttcgatgcattatatgataccatttaaaagcccttcggagagggaggtcttcataatgactgagaatgttaacttttttttaaagttattcgttgaatatttacaaattgaaaaaaattattcacaatatactattgtgaattatgttaattcgattgaagaatttgggatgtttctgcatgctcaaaatataaatggaatgaaagaagctgcatatcatgatgtgagaatatttttgacagaggcttatgaaaaaggcctgtcaagaagaacaatcagcaagaaaatttcagctttgagaagcttctataaatttttaatgagggaaaagcttgttgaagagaatccgtttcagcttgttcatctgccgaaacaagagaaacggattccgaagtttctttatgaaaaagaacttgaggaactattcgctgtctcagacagaagtcagccgtcagggatgcgcgatcaggccctgcttgagcttctttatgcgaccggaatgagggtcagtgagtgctgtacgctcactgtcggcgatcttgacctgttcatggatacggtgctcgttcacgggaaaggcaagaagcagcgctatatcccgttcggctcatatgcccgtgatgcgctggagctgtatatcaacagcggaaggcagtgcctgcttgaaaaagcaaaagagcctcatgatgtgctgtttgtcaatcaaagaggcggcccgctgaccgccagaggaatccggtatattttaagcgggcttgtaaaaaaagcatccggcactttacatatacacccgcatatgcttcggcacacgtttgcgactcatctgctgaatgaaggggctgatttaagaagcgtccaggagcttttgggccattccaatctgtcttctacgcagatatacacgcatgtatcgaaggaaatgctgagaaacacatatatgtcccaccacccgagagcttttaaagaaaattaaaaggaggcccttctcatgtcatcttttcatgcgacaacgatttttgccgtccagcataacgggaaaagcgctatgtcaggagacggccaggtcacattcggtcaggctgtagtcatgaaacataccgcgagaaaagtgagaaagctgtttaacggaaaggttctggccggatttgcgggatctgttgcagacgctttcacactttttgaaatgtttgaggcgaagcttgaagaatacaacggcaatttaaaacgtgcgtcggttgagcttgcgaaagaatggcgcagcgataaagtgctgcgcaagctggaagccatgctgattgtcatgaaccaggataccttgcttctcgtatcgggaacaggtgaagtgattgagccggatgacggaattttggcaatcggctccggcggaaactacgccctgtcagcaggaagagcgctgaaaacctatgccggagagaatctgtccgccaaagatattgcaaaagccgctttgaaaatcgcaggcgagatttgtgtgtacacaaacgatcagatcattttggaagaacttgaatagaaaggacttgaggcgcatggaaaacaaaccgttaacaccgagacaaatcgtagatcggttggatcaatacattgtaggacagcaggatgcgaaaaaagctgtcgccgtggcattaagaaaccgctatcgcagaagtcttcttgatgaaaaactgagagacgagatcgttcccaaaaacatcctgatgatgggcccgaccggggtggggaaaacagagatcgccagacggatcgccaagcttaccggtgcgccatttataaaaattgaagcgacaaaatttacagaagtcggctatgtaggcagagatgtcgaatcaatggtcagagacctcgttgagacatccgtgcggctcattaaagaagaaaaaatcagcgaagtgaaagaacaggctgaagaaaatgcaaacaaacgtatcgtgcggcttctcgttccgggaaagaaaaaacaagcgggtgtgaaaaatccgtttgaaatgcttttcggaggaagtcagacggcaaatgatgatgaagccgatcagcaggaagaagcaagccttgaagaaaaaagaaaacgcatggcgcatcagctcgcattgggagagctcgaagaccattacgtctccgtagaggtggaagagcagcagccgtcgatgtttgacatgctgcaaggctccgggatggagcagatgggcatgaatatgcaggatgcgctgagcaatctgatgccaaaaaagaaaaaacgccgcaaaatgacggtcagagaagcaaggaaggttctgaccaatgaagaggcaggcaaattaatcgatatggatgaagtcggccaagaggccgtgttaagagctgaagagggcggcattatctttattgacgaaatagataaaattgcaaaaaacggaggggcttcttcctcagcagatgtatcgagagaaggcgttcaaagagatatccttccgattgtcgaaggatctaccgtcgtcacgaaatacggctccgtcaaaacagatcacgtgctgtttatcgcagccggggcattccatatggccaaaccgtctgatctgattccggagctgcagggccgctttccgattcgtgtagaattgagcaagctgacggtggatgattttgtgaagattctcgtcgaacccgataacgcgctgttaaaacaatatcaggctttattgcagacagaaggtatatctcttgaattttctgacgaagctattcgtaagatcgccgaagtggcttatcatgtgaatcaggatacggacaacatcggagcgagaaggcttcacacgatattggaacgtctcttggaagacctgtcgtttgaagcgccggacgtgacgatggaaaaagtcgccatcacgccgcaatatgttgaagaaaagctcggaacgattgcaaacaacaaagatctaagtcaatttatattgtgaaaatttaataagaggaattctaggaggattatttatcatggctttactacaaaaaacacgaattattaacagcatgctgcaggctgcggcaggcaaacccgtaaactttaaagaaatggctgaaacgcttcgtgacgtcattgattctaatattttcgtcgtcagccgcagaggaaagcttttgggctactctattaatcagcagattgaaaatgaccgcatgaaaaaaatgcttgaagaccgccagttcccggaagagtacacgagaaatctgttcaatgttccggagacgtcttcaaaccttgatatcaacagcgaatacacggcatttcctgtggaaaacagagacctgttccaagcgggcttaacaacgatcgtgccgatcatcggcggaggagagagactgggcacgctgattctgtcccgtctgcaggatcaatttgaagatgatgatctcattcttgctgaatacggagcaaccgttgtaggaatggagattttaagagaaaaagcggaagaaatcgaagaagaggcgcgaagcaaagcggttgttcaaatggcgatcagttctctgtcttacagtgaacttgaagcgattgagcatatctttgaagagcttgacggaaacgaaggcttgctcgtggcaagtaagattgcagaccgtgtcggcattacgcgttcagtaatcgttaacgcgctgagaaagctggaaagcgcaggcgtcattgaatccagatctctgggtatgaaggggacgtacattaaagttctgaacaacaaattccttattgaattggaaaaccttaaatctcattaagacaaaagcaggatccctgaaaatgggggtcctgctttttttatggacaataggtgaaaagttgcagtttaaagttgcttattggaagctgatctgagataatccatcttgctgtgtgaaaaaaggaggaagatacagaaattctgctattttcagtcttatattaaacaaatacttgtagtccaaatactctaggacttaatacctacatgcaaaatagatataattgagcacttttttttagcctaacttcatagactttaagcctgttatttcttacaataagcatatggttttacaattctcgacaaggatttttaggagaaaaatatctgaaatggaggtaagtggatttggacttattttctggaactatacaaaatcttgagaatgccttggggagagcggacattaagcaaaaagtcttaactaataacatcgccaatatagatacaccgaactataaggcaaaaaaagtctctttccgaaatttgttagatcaggaaacatccaatcttgaggcggtaaaaaccgactatcggcacgttgactttacgggttcaagggacgattattctatcgtgtccagcagtgatacatcgtaccagcaaaacggaaacaatgtcgatatcgacaaagaaatgacagatttagccgaaaaccaaattaattatcaggctttggttgaaagaatgagcggcaaattcaattctctgaaaaccgtcttgacaggaggaaaataatgagtggctttcaaagcttaaatatttcgggttccgctttaactgcacagcgtgtccggatggacgtcgtatcgtccaacctggccaatatggacacaacgagagcgaagcaggtaaatggcgaatgggtgccttacagaagaaagctggtatctctccaatccggaggcgaatcattttcgtcccttttacattccaagatgaacggaacaggaagcgcgggaaatggcgtaaaggtatctggcgttacggaagacccgtccgcttttaatctcgtttatgatccggagaatcctgatgcgaataaagacggatatgtacaaaaaccaaatgtagacccattaaaagaaatggtggatcttgtcagcagcacgagatcatatgaagcaaacgtaactgcattaaacgcctccaaaggcatgcttttaaaggctttagaaatcggaaagtaaggtgatgtaagtggttaacgctattactccttttcagcttcaacaaacccaaaacactcaaaacgtaacgaatcaattaaaccaaactcaaaaaactgattcttcaaaccaaacaagcttttcggagcttttaaaaaactctattgattcgttaaatgagtcacaagtaaaatctgaccaaataacgaacgaactggctgcaggaaaggatgtaaaccttgacgaggtcatgatcgctgcccaaaaagcaaatatttctctgacggccgctaccgaattccgcaataaagccgtggaagcctatcaggaaatcatgagaatgcagatgtagtggtcagattgaagagaatgactggaatgaccgggggttaacatgaatcgtactctaatgcaaatgaaaaccaaaacggcagcgttttggaacaacagatcaaaaacacagaagatactcatggtaagcggcttggccgcattcattattttactcatcgtcgttattatttttacttcgtctgaaaagatggtgcctctttataaagatttgtccgcggaagaagcggggaagattaaagaagagctcgatacgaaaaaggtgtcttctgaacttgctgacggcggcacggtcataaaggttcctgagagccaagtggattcgcttaaagtccagcttgccgcggaaggcctgccgaaaacgggatcaattgattattcgtttttcggacaaaatgcgggcttcggcctgacagataatgagtttgacgttttaaaggttgaggcgactcagaccgaattgtcaaacctgataaatgaaatggacggtattaaaagctcgaaggtcatgatcaatatgccgaaagaagccgtgttcgtcggtgaagatcagccggcagcgtccgcatccatcgttttgcagatgaaaccgggctactcgcttgatcaaaaccagatcaacgggctgtaccatctcgtttctaaaagtgttccgaacttaaaagaagataatatcgtcataatggatcaaaattctacatattatgacaaaagtgacagcggtgcagggtccgtttctgacagttatgcatctcagcaaggtattaagtcgcaggtcgaaaaggacattcaaaaacatgttcagtcactgctcggcacaatgatggggcaggataaggtcgttgtttctgtaacggcggatattgacttcacgaaggaaaaacgcactgaagacactgtcgaacctgtcgataaagataacatggaaggcatagcggtaagcgccgaaaaagtcgcggaaacgtataaaggcgatggcgcggccaacggcggcacggccggaacgggaagcaatgacaccgcgaactatgccgagacaaacggcggttcaaacagcggggactacgaaaaaagcagcaataaaatcaactatgaagtcaaccgcattcataaagaaatcgcggaaagcccgtataaagtgcgtgatttaggcattcaggtcatggtggagccgcctaatccgaaaaatgccgcttccttatcggcacagagacaggctgatatacagaagattttaggaacggtcgtcagaacgtctcttgataaaaacgaaacgcaaaatcaaaacctgacagacaatgatatcaacaataaaatcgttgtatccgttcagccgtttgacggaaaaacaagcctgaacacagattcggcacaatcttcaggtcttccgatctgggtatatattacaggcggcgtactgcttgcggccattattctgcttatcattctcctcatcagaaagaaacgctcacaagaggatgaatacgaagaatatgaatatgaaacaccgccggagccggttcgattgcctgatatcaacgaagagaaaattgaaacggaagaaacagtcagacgaaaacagcttgaaaaaatggctaaagaaaaaccggaagactttgctaaattgcttcgaagctggctggacgaggattagggggaatggaaaatggcgaaacgtgatcagaacaagcttacaggaaaacaaaaagcagccatcctcatgatttccttaggccttgatgtatcagcttctgtgtacaagcatttgtctgaagaagaaattgaaaggttgactctcgagatttcgggagtcagaagcgtcgatcatcaaagaaaagatgaaatcattgaagaatttcataatatcgcaatcgctcaggactatatttcacaaggcggtttaaattacgcccgccaagtgcttgaaaaagcgctcggagaagacaaagcggtaagcattttaaacaggctcacctcttctttgcaggtaaagccgtttgattttgcgagaaaagcggagcccgaacagattttaaatttcattcagcaggaacatccgcaaacgatggcgctgattttatcctaccttgacccggtgcaggccggacagattttgtctgagctgaacccggacgttcaggctgaggtggcaagaaggattgcggttatggacagaacgtctcctgaaatcataaatgaagtggagcgggtccttgaacaaaagctgtcctcctcctttacgcaggattatacgcagaccggcggcatagaagccgttgttgaagtgttaaacggcgtagacagaggaacggaaaaaacgatccttgattcattagaaatccaagatcctgaattggcggatgaaatcaaaaaacggatgtttgtctttgaagatattgtcacccttgataaccgtgcgattcagcgcgtgatcagagatgttgaaaacgacgacctcctgctttcattgaaggttgcgagcgaggaagtcaaagagattgtcttcagcaatatgtcacagcgtatggttgaaacatttaaagaggaaatggaaattatggggcctgtgcgtttgcgtgatgtggaagaggcgcaatcaagaatcgtgggcgtcgtccgcaagctggaagaagccggagaaattgtaatcgcgcgaggcggaggagacgatattattgtctaatatcattaaacagcaaacatcattttctcctgaacaaaaacggcgcaagctatccttgcaggaagtcaggaaaacacattcccagccagaccgggaggaacctgaaaatccggaggcactcatggcctttgccaaggccgaagccgacagggtgtctgaagaagcgaaaagtcaattggatcacactcttcggcagattgaagaagagaaaaaccgctgggcggaagaaaaacaaagattgattgaagaagcgaaggcagaaggatataaagaaggcatggcattgggaaaagccgatgctcaagcagaatatgccaatctcatcagccgggccaatgccgttatggaaatggccagacaatcagtcgaggaaaaactggaaagcgctgaggaagaaattattgagctttctgttgcgctcgctaaaaaagtatggcggcaaaaaagtgacgataaagaggctttccttctgctggtcaaacaggtagtagccgaagtaaaagattatgatgacatctccatctatgtggaccctgaatattatgagacggttcatcagcatatggacgaaattcagcagctgttatacaaagaatgcagattaagcttatatgccgatgaaaaagccgcgaagggaacgtgctcgatagaaactccgttcggacgtgttgatgcaggcatagacactcagctgatgcaattaaagcaaaagcttttaacggcgcttgaggcgggagcggagcaatgaagacacagtatttaatagactcaattgaaacagcggatccgtacaaacgctacggcaaggttaaacgggtcatcgggctgatgattgaatcaaaagggcccgaaagctcaatcggagatgtttgtctcatttatccgaaaggccatgcgaaaaaagcgattaaagctgaggttgtaggcttccaggatgaaaacattctgctaatgccttatctggaagcggccagcatagcgccgggcagcattgtggaggccactggcgagtcgctccgcatcaaagtaggggcgggtttaatcggacaagttgtcgacgcgttcggcgaacctcttgacggccgggcgcttccgaaaggtttgtcccccgtttcgacggaacagccgccgccaaacccgatgaaacgcccgccgatacgggaaaagatgggtgtcggcgtcagatcgattgacagtctgctgacggtaggaaaagggcagagaatcgggatttttgccggaagcggagtcggaaaaagcaccttgatgggaatgattgcgaagcagactgaagctgatttaaacattatcgcacttgtcggtgaacgggggcgcgaggtgcgtgaattcatcgagaaggatttaggcgaagaaggcctgaaacgctcgatagtcgtagtcgcgacctctgatcagcctgcgttaatgcgattgaaagcggcgtatacggccaccgccattgcggagtatttccgcgataaaggccggaatgtgatgttcatgatggactccgtcacgagggtcgcgatggctcagcgggaaatcggcctggcagcgggagaaccgccgacaacaaagggatatacaccttctgtgttcgctattttgccccgtttgctggaaagaacgggcgcaaatgaacaaggaacgataaccgctttttatacggttctcgttgacggagatgacatgaacgaaccgattgccgatacggtgcgcggaatattagacgggcatatcgttctcgatcgggcgcttgccaacaaaggacagttcccggccgtgaacatcctgaaaagcatcagcagggtcatgtctaatatttcagacacagcgcacatagaggcggccaacaaattccgcgatcttctgtcaacttatcaaaactctgaagatctcattaatatcggagcttacaaaagagggtcatcaagagaaattgatgaagcgattcagttttatccgcagcttattcaatttttaaaacaaggaacggaagaacctgctcaattggaagacagcattgcggcattgacgagtctgacaggaaaagaggaataaacatcatggcgtaccaattcagatttcaaaagctgctggaattaaaagaaaatgaaaaagaccaaacattgactgaatacagacaatcggtttctgaatttgagacagtggctgaaaaactatatgaaaatatgagcaaaaaagaattgctcgaaaaagacaaagaatcaaagctgaaatgcgggatgagcgttcaggaaatgagacattatcagcaattcgtttccaatcttgagaacaccatctatcattatcaaaagcttgtcatcatgaaacgaaatgaaatgaatgagaagcaggaacagctcaccgaaaaaaacattgaagtaaagaaatttgaaaaaatgcgggaaaaacaatttaatatgttcgcacttgaagacaaagctgcagagatgagggaaatggatgacatttcaatcaagcagtttatgattcaggggcattaggagcgaatgaaatggccgaaaaagaaaagagatctggaaagttcggttcaatcctgctttttatcatgatcccgctgatttttctgatcatcgtcgcaagcatcatcctttgggctgccggcgttgatgtgatgaagccgattcaggaaacagccgctaaaacgcctgttttaaaagaattggttcccgaaacgaaagaaatgaaaagcgcggcggaaaagcagaaggaagacagaacggcttctcttgaaaagaccataaaggaacaaaaaagtgaaattaacattttgaataaagatttagatacaagcaagtccgaaatcgataatctgaatcagaaaatccgttcgctgaaacaggaagctgaacagcagcagaaaacgaagacggatgaaacgaaaaaagacgcttcggattcagccggaaaagataaaatgatcaacatctataaaagtatggacagcggtaaagcggcaagcattatcgtaaagctgaaagaaaaagaagccctcgatattttaaacggattaagtaaaaagcagcttgctgaaatcttgacgaaaatgactcctgaacaagcggctaaatatacagaaaaactatccgctgacggaaataaggagtgatgtaagttgaagctgcttgaattaacgggtaatcgtacgcagactgcgcaaaacagcaatgtgaagatgaatgtaaacagcttaggtctatttcagaactggctcctgtcggaaatcacttctccccggcagcccggagatgaaacaaaaacaagtgacgcagagctgaatgatgccctatcgaaaatcggtgattggctgaaagccggcccggaagataaagaattgcagcttaaacagctgcttgaggcggtaaaagctcttgaaggaaagcagacggctgaaacagctcttcctttattgaaacagcttgccgaatccgttgaagacatgttagcgggaaaacagcatggggcgaagcctgaaacgaatgagccggattcttccgcaaaagacggggattccgtcaaggatgcgcttgagaagggcctgcttttcattcaagaagccgtattccagctcttcacatctcagcaggaactgccggacagcacgcaggcaaaggcggtttaccaggaaggcgcccgtttattagaggcattgaaaaaacaaggtgttccggaccgcgtgattcaagacctgcggcagacattttttccgaaaaacgaatctgcatctaaactttactccatgacagccgctgagctgaagagctttcaaagcgtcgcggagcagcttgcgggcctttctcaaaagggaacaaaggaatgggatatggctgaaactgagctgaaagcttttgtgttatctcaatcatctgaatcatcccaagagtcagccgggaaaacggaacagcaaaacggcggcacggtttctcacgcaaaggcgcctgacagcaaattgtctgcacatatactgttttcgggaacgagaagccttgccggcattcagcaagcgtccgcaggagctgaacagcagccggcagaaaataaaccgttaacggatcaggtcatcagcggctggaaacagatgaaatacacgcctttcgggaaaacaaccggaagctttacgattcgtcttaatcccgagaacctcggatttgtcacaattaaggtgacaaacgaaaacgggatgtttcaaagcaaaataatcgcatccagccagtccgcgaaagagctgctggaacagcatcttcctcagctgaaacagtcgcttccgaatatgtcggtccaggtcgaccgttttacagtcccgcttcaaggcggggatcagcagcctgtttacgggcagacggccgatcacaataaacagcagcatcagggacagagagagcagaagaacaagcagcagtcaggcgatttcggagatatgctggaggagctttctctcaatgaaatggaggaagaataggtgacatcagtaaactcggattatgccgcggcgggcgcttcaaccacttcaaacgcgaagagcacctccgcagtaaacagcagtacgaatttagggaaagacgaatttctgaagatcttaatgacacaggttcaaaaccaggacccgctcaatccggttgatgacaaagaattcatcagccagatggcgacattttcttcattggaacaaatgatgaatatgaatacgacgatgactaaatttgtagaaaatcaagatccgtttacgatgtatgtgaactggatcggcaaaaatgtcacattcagcgacagcgacgggaaggatcagacaagcccagtcaattcagtcaagcattcaaacggcaattacgtgctcgtgcttgaaaatggcaaagaggtcagtccgtggaatgtcacggccgtcagcgaaacatctaaataaaaagaaacccagggggaatttaacatgttacgttcattatattccggtatcagcggcatgaaaaactttcagacaaaactagatgtaatcggcaataacatcgccaacgtcaacacagtgggatttaagaaaagccgcgttacatttaaagatatgatcagccagacagtcgccggcggttcaaacgtgaccaattcaaaacaaatcggcctgggtgccgcgacttcttccattgatgtcgttcattcaaccggcgccccgcaggctacacagaataaaaccgacctagccattgacggagacggctactttcagattaatacaggttcgggaatcgtttacacacgtgcggggaatttcggaaaggacaatcaaggcaaccttgttacgactgacgggtactaccttgaaaaaatcggcggcggcaaaatcaatattccgactgatgcgaaagattacagcatcggtgcagacggaaccgttacatacactgatgcaggggatgcggttcatgatgccggacaaatcggtctggtcacgttccctaacagcgccggtctggaaaaaatcggaggcaacctttacagagaatcattaagttccggagctgcgagcgcagtcaccactccgggcgaaaacggaacgggtaagcttttggcaggctatcttgaaatgtcaaacgtagatctgacagatgaatttaccgaaatgatcgttgctcagcgcggtttccaatcaaactcaaaaatcattacgacttcagatgaaatccttcaggagctggttaatctgaaacggtaaggagggaggagaggcggttaggccgcttctccggattgcatgattcaagtcacccgtttaaacggccagccttttacgctgaacgcgctgtttatcgaacagattgagtgcttccccgacacgacgattacactgtccaacggcaaaaagttcgttgtgaaagaaccggaagaagcagttctcaaaaaagtcatatcgttttaccatagcatacaaatattttcactggatcagggaatagaggaagaagaatgaagaaaaaattagtcatcattttgctgattattttaattgtcatcgccggcctcggaacggcagcatattttgtcgtcagcggacattccggcaaagataaaaagccgacaattgacgaagtcgttgcagccactgtgtctgtcgacgatatcacgacaaacttaaagtctgacagcatcatccgtatcggcatcaagcttgaaaccgactcggctaaagcgaaggaagaacttgaaaaacgcgattttcaggtgaaagacaacatcatttccattttagctgacacaagcgccggagagattgagggagataaaggaagagaagcgtttaaacaatcattaaaagagaaagtaaacagctatctccaagaaggaaaagttcagaaagtgtacattacctcctttaatctgcaataaaaacaaatttgacagaatacggaggtgaagaaaatgtcaggagaagttctctcccaaaatgaaatagacgcactgctttccgccatttccacgggtgaggcggatgcggaagagctgaaaaaggaagttaaagagaaaaaagtaaaggtatatgattttaaacgggctctcagattctcgaaagatcagatacgcagtttaacccggatacatgataactttgcgaggcttctcacaacacacttttccgccaagctcagaacgtatattcatatatccgtcagctcagttgaccaggtgccgtatgaagaatttatccgttccataccgaacatgacgattttaaatttattcgatgttcatccgatggaaggcagaatcatgatggaggttaatcccaccatcgcatacgcaatgcttgaccgcgtcatgggaggcatcggcatcactcataacaaagctgacagccttacggaaattgaaacgaatattatttctaacttatttgaaaatgcactgggcaactacaaagaagcttggcaatcgattgctgatattgaccctgaaatgactgaatttgaagtgaatcctcagtttgtacagatggtttccccaaatgaaacagtcgttgtcatttctctcaatacacagataggtgaaatcagcggtgtcattaatctttgtattccccatgtcgtacttgagccgattatccctaagctttccgtacattattggatgcaatcagaccggaatgaagcgaagcccgaagaaacgaagctgcttgaaaagcgcatcatgacggctcaaattcccgttgtggctctcttgggcgcttctgaactgacaatagaagaatttttaagtttggaagtcggggactgtataactctggacaaatcagtgactgatcctcttactgtattggtcggaaacaaaccgaagtttttagggcaggccggccgggtgaatcgaagacaggcagtgcaaattttagatcacgacataagaggtgaacaagatgaacaatagattatctcaagatgaaatcgatgctcttcttaacggcacaagcagtcagtcagaggatacagaacagcctcaagaggcgaacttgtctgaacttgagcgcgatgcgatcggagaaatcgggaatatttcgttcggcagctcggctacggcgctgtccactcttttaaatcaaaaagtggacattacgacaccgagtgtgaccgtcatttcaaaaagcaaaatcagtgatgaatttcctcatccgtatgttgccattgaagtgaactacacagaaggctttgacggcagcaatttgctcgtcgtcgaacaaagcgacgcggcaatcatcgcggatttgatgatcggcggagacggccggggcgccgatccgtcactcggtgaaatccacctgagcgccgtgcaggaagcaatgaatcaaatgatgggctcggctgctacgtcaatgtcgaccgtattcagtaaaaagattgacatttctccgccaagggttgaacttctggatgtgacggaagaaaaagggaccgacagaatacctgaggatgacctgctcgtaaaagtgtcattccgtctgaaagtcggcgaattaatcgattcgagcatcatgcagctttatccgattacgtttgcgaaagatctgatcgcagacctgatgactgcggaccagcatgagtcagaggccgcagaaaccgcatcagaaccacaggaaacatacgaaacgccgcagccggaacctgccatgcagccggagccgcaggcaaaacccgagcttccgaagagacagggaaccgcaaaaaaagctgctcctgttcaagtcgctccggtagaattccaggcgtttgatcataacgaagcggcgcaaggatcaaggaataaccttgatatgctgatggatattccgctttccgttacggttgagctcggcagaacgaagagaagcgtcaaagaaatccttgaactttctgcgggaagcattattgagcttgacaagctggctggtgaacctgtggacatcctggtcaaccagcggatcgtggcaaagggcgaggtcgttgtcatagaagaaaacttcggcgtgagagtcactgatattttaagtcaggcagaccgccttaacaatttaaaataagcgaacatagaggagagaaacagattatggcacacagaattttaattgtagacgatgcagcatttatgagaatgatgatcaaggatattttagtgaagaacggttttgacgttgtagctgaagcttcagacggagcgcaggcagtcgaaaaattcaaagagcattcccccgacctagtgacaatggatattacaatgcctgaaatggacgggattacagctctaaaggaaattaaacagatcgatccgcaggcgaaaatcatcatgtgttcggctatgggccagcagtcaatggttattgacgcgattcaggccggcgcaaaagactttatcgtgaaaccgttccaagcggaccgcgtgcttgaagccattaataaaacattaagctaaagggtgtacgactgttgaaaaagagtcatggtttactagctttgatttgttatttcgttttactcaatgtacatccgttccctgcttttgcggcagagtctgataattccaccgtcaacgaatggtttgacaaacaatcaacaaacaaaacagagaaaaaaagcgatacatcgaaacaaacggctgatcaagagataggggatgcttctgcatcttctgtctccgcttttgattttgtaaagatgatcggggcgttattattcgtcattctgctgatctatggatttgtcaaactgatgaatagaagaaaccgtctgctgaagccgtttcaatatgtagaaaatatcggcggaacgtcagtcggccaaaatcgttccgtgcagctgattaaagtgggaaacagcgttctcgtagtcggtgtgggcgaaacgatacagcttttaaaagaaatagaagatgaaaaagagcgcgaggcgattctgagccaatacgaagagtcgatgtcttcaaaagtggaatggaccaagctcgtaaatccgcgtaaggatggagaaaaaaagccgcaaacgatgcttccgtcgttttcaaaagcgctgaaagaacagctgaacgagctgaaacaaagccgttctgaaggaaagaagaaaggcccttatcatcatgaatgaattcgttaatctttttaattcaagcaatccgaccgaagtcagctccactgttaaattactgctgcttttgactgtcttttcagtagcgccggggattctgattttgatgacctgctttacgagaatcgtcatcgttctgtcttttgtgagaacctcactggcgacgcagaacatgcctccgaaccaggttttaatcggccttgcgctgttcttgacgttttttattatggcgccgactttttcagagattaataaggaagccttaacgccgctgatggacaacaaaatcagtctcgatgaagcatatacaaaagccgagaagccgattaaagagtatatgagcaagcatacaaggcagaaggatctggcgctgtttatgaactatgccaaaatgaaaaaacctgaatcgattcaggatattcctttgacgacgatggtgcctgcttatgcgatatcagaactcaaaaccgcttttcaaatgggctttatgatttttattccgtttttaattatcgatatggtcgtggcgagcgtcttaatgtcaatgggaatgatgatgctaccgccggttatgatctctctgccctttaaaatattgcttttcgttttggtcgatggatggtatttaatcgtgaaatctttgcttgacagcttttagggtaggtgctaattgtgagttcagaatttgtaatttccatggcggaaaaagccgtatatgtaacactaatgatcagcgggccgctgcttgccatcgcgctgatcgtcggtttgctcgtcagtatctttcaagcgacaactcaaatccaggaacagacgcttgcgttcattccgaaaatcgtggcggtgatgcttggactgatctttttcggtccttggatgctgtcgacgattctttcgttcacaactgatctgttctctcatctgaaccgatttgcagggtagaatcaaatgaattccatcattgatttatttcccgcttttttattggtctttatcagaatctctgctttttttgtaacggtgccggtgttcggacatcggaatctgccggcggttcaccgaatcggctttgctttttttctttcggtgatctgcttcagcacgctgaaacatgcgccggaaatagaaataggggaacagtatatgctgcttgtcataaaagaggccgttgtgggcttgagcctcgggctgattgctttcatgatgatgacagccattcagatagcgggttcctttattgattttcagatgggcttttccatcgccaatgtcattgatccgcaatcaggaacgcaaagcccgctgatcggacaattcgtttatacgctggcgctgttatttatgctcagcgtaaacgcccattatcttttattggacgggatttattacagctttcagtatatcccgcttgatcaggcatttccgtcgtttggaaatgatcactttggactttttatcgcaaaaagcttcaatgccatgttcattatcgcttttcaaatgtctgcgccggttgtggccagtctgtttttagttgatttggcgctcggtattgtggcgagaacggtgccgcagctgaatgttttcgttgtcgggcttcctctgaaaatagccgtgagctttattatgctgatcgtttgtatggcggtgatgtttgtcgtcgtccgcaacatcttcagccttaccgttgaaaccatgcggaatctattggcattggtcggtgtgacatgatgagactcagactgaatctgcaattctttgccggtgaaaaaacggagaaagccactccgaaaaaacggaaggatacaagaaagaaaggacaggtcgcgaaaagtacggatgtgaatacagccgtttctttactgattatctttctttcgctgatcgcgctcggtccttatatgcgggacaggctgctgtcctttattaaaacgttttatacgaaatcgatatcattacatctgtcagcatcttccgtgcatgaactgttcgtagatacggtgaaagatatcagcctcatcctcgcgccgattatgctggtcgcgcttgtggcaggtgtcgtgagcaattacatgcaggtgggttttctgttttctgcggaagttctcaagcctgacttgaataagctcagcccgctgaaaggatttaagcggatttacagcatgagggcgattgttgaactggtcaaatccattttgaagattactgtggtcggttttgccgcctttatggtgctctggctgcattatggcgatattctccgccttccgcttttaacacctgcggaagtgctcactttcgtttctaagctcacgctttggatggggcttgcgggatcaggggctctaatgctgctggccgggcttgattatttatatcagcgttttgactatgagaaaaatatcagaatgtcaaagcaggatataaaagatgaatacaaaaaatcggagggtgatccgattatcaagtccaaaattaagcagaagcagcgggaaatggcgatgaggcggatgatgcaggaagtgccgaaagcggatgtcatcattaccaacccgacccattatgcgattgctttaaaatatgatgaaaagaaaatggccgccccttacattgttgccaaaggggtcgaccatcttgcattaaaaatcaggcagatcgccaaagaacacgatgtcatgacgattgaaaacaggccgctcgcgcgtgcgttatatgatcaggttgacattgaccaggctgtgccggaagagtttttcaaagtcattgcggaaattttggcttatgtatataaaacgaaacaaaaagtatagcgaatttcagattcaaaaggagagaaaaacagcatgtcaacaagagatttatcggttttaataagtgttgtcctcattgtggcaatgctggtgattccattccctccatggttgttaagtattttgatcatcattaatatctctcttgcgttgatcgtgcttctcaccacaatgaatatgcaagaaccgctgcaattctcgatattcccgtcattgctgctgttattgacgctgtttcggcttgcgctcaatgtgtcgacgacacgttcgattctttctcacggagaagggggaaaggttgttgagacattcgggaatttcgttgtcggcggaaatgtgctggtagggcttgttgtcttcattatcttaattattattcagtttatcgtcattacaaaaggcgccgagcgggtatcggaagtggcggcgagatttacgctcgatgcgatgcccggaaagcaaatgagtatagacgcggatttaaatgccggcatgattacggagcaggatgcaaagcacagacgtgaaaaagtcgcccgggaagcggatttttacggcgccatggacggtgcgagcaaattcgttaaaggggatgccatcgcggggatcatcatcgtgatgatcaatattattttcggaatcgtaatcggcatgctgcagcaggggatgagcatacaagaagctgcgtctcactttacaatgctgacggtcggtgacggtatcgtttctcaaatgccggccttgctcatttcaacggctacggggattgtcgtgacgagagcggcatctgaaggaaacctcggtcatgatattacaggccagctgtttgcttatccgaagctcttgtatgtagccgcgggaactgtacttttgctcggtcttcttacaccgatcggcattctgctgacggggccgatcgccggtctgcttgcattcggcgcttatatgctgtccaaagcggataagccgagcgaagaagaggaagaaattcttgaagaagaggctcaggcggatgaactgaaaagcccggaaagcgttgtgcagcttttacatattgatccgattgaatttgagttcggatacggactcgtgccgcttgcagacgcggggcagggcggtgatcttcttgaccgcatcgtcatgatcagacgtcagcttgcgcttgaattgggacttgtcattccggttgtgcgcatcagggataacatcgcactccagccgaatgaatacagattgaaaattaaaggcaatgaagtcgctaaaggagagctcctgctggatcattatttagcgatgtcaccgacgcctgaagatgacgtcattgaaggaattgaaacgattgaaccgtcgttcggacttcccgcaaaatggatcagcgaagctgcaaaagatgaagcggacatgctggggtatacagttgttgatccggcgtcagtcgtatctacgcatattacagaaaaaattaagcagcatgctcatgaactggtcggcagacaggaaacaaagcagctgatcgatcatctgaaggaaaattatcctgtgcttgtcgaggaagtcacgccgaaccctctttctgtcggcgatattcaaaaggtgcttgccaaattgctgagagaaaaagtttcaatcagaaacttggtgaccatttttgaaactcttgccgattacggaagattaacgacagattcagaccttttgacagaatacgcgagacagtcgcttgccaaacaaatcacggcacaatatgcgagagagcatgaaacgctgaaggtcatcacatgctcaggccgggtggaaaaagcgattgcagacggggttcagcagactgaacagggcaattacctgtcactcgaccctgaggtttcggacagcatcatccgttctgtcgctaaagaggccgagcagctttccatccgtcaggagtcggcgattcttctttgctcgcctgctgtcagaatgtatgtaaaacagctgttagaacggtatttccctgatcttccggttctttcttataatgagctggaagcaaatgttgaagtacagagcattggagtggtggatatttaatgaaaataaaaaaatttacagccgcttcaatgcaggatgccgcgaagcaaatcaaaaaggaactcggcaatgatgccgttattttacattccaaacaagtaaagaaacgaaaatggctggggctgcggtcgcagcaggccgtcgaagtgatagcggttttagatcgtgacgtcagggaagcgagaaaaacgccgccggctgccgctgaagaaatgaaaaagacggaaacggcggagaaagctgagcctgttcagccgccgcgccttccggatcaaagtatttccggcgaactggcgcatttgaaagaagtgctccctgaaccattaaaaaaagccgagagactattgaagcaagccgggcttcctgatcatacgcaaaacgctgtactcagtgaattgctcagttcttcaattgtttccggagatttaactgaagataatgtcagctcaaagctgcaggatttgttagtgaaaaaactcccttcgacagacaggtggcaggaagggattcaatcaaaatacgtcgtgcttttcggttcaaccggggccggcaaaacgactacacttgcgaaacttgcggcctcatcaatgctgacagagcataaaaaaattgcctttatgacgacggatacttaccggattgccgcggtcgagcagctgaagacatatgcggagctgcttcaggctcctcttgaagtatgctattcaaaggaagaatgtctgaaggcactggaaaaattcgctgaatacgaccatgttttcattgatacagccggcagaaactttaaagaagagcagtatattacggaattacaagagatgattccgtttgaatcaggcttacaatcctttctcgtattatcggcatctgcaaaatatgaagatatgaaacaggtgctgaaacagttttccggtgtgccggtcaatcaattcattttcacgaaaacggatgaaaccgcctcactcggctccgtgtttcaagtgctgtcggaatcaagaatcggcgccgcctatttgacaaatggacaggatgtgcctgaagacatcctatcggcttcaccaaaagagtttgtaaggatgcttttggcatgaaacccgatcaggcagagtcattaagaaggaaaatgagagagaggcaaatgatcaagccggagctttatgagaaaaaagcgaggacattagccgtcataagcggtaaaggcggcgtcggaaaatctaatttaacattaaacatggcagttgccctgcaggaaaaaggaaaaaaagcactcatcattgatcttgacatcggaatgggcaacattgatgtgctgatcggagctgcttcttcccgcaccattattgatgtgatggagaatcggcacgcgttggctcaatcactttcctccggtccgaaaggccttcgctacatatccggaggaacggggcttgaggcgttctatcaagcagacagagagaagtggtcggcttttatgaatggtctttccgctgtattaagcgattttgattacgttctgtttgatatgggagcgggactttcaaaagaacagctgccgtttattttatcggcggaagacattctcgccgtgacaacgcctgagccgacggccattatggatgcgtacagcgcgatcaaacatcttttgctcgcggatgaacggctgaccgtaaacattgccgtcaatcgcgcccgcgctcaaaaacaggcgctggacacgtacaaccgcctttctcatgcgatccacacgtttttaggcgcggaggtgcgtttcgccggctccatacccgatgatccgctagtaagtcaagccgtcattgaccaggtgccttttttaataaaaagtcctcaagcaaaagccagcaggtccgtccgtcttctgacggatgtcttgtttcaaacggaagaaaacaaaccaagagaagagaaaccggcatttattgagagattatcttcttttttattgaggaggactttacagtgattcgtgtgcttgtcgttgatgactcagcttttatgagaaagatgattaccgattttctggctgcggaagtgcagatagaagtcatcgggacagccagaaacggggaagaggcgctgaagaaaatagagcttctcaaaccggatgttgtcacgcttgatattgaaatgccggtcatgaacggaacggatacattgcggaagatcatcagcatatataaacttcccgtcatcatggtatcgagccagacacagcaagggaaggaccgaacgatcaactgcctggaaatgggcgcttttgattttatcactaagccttccggagcgatttcacttgatctttataaaattaaagagcagctgattgagagggtgattgcagccgggatgtcccgcgcacaaaaacctgaggcggcagtgaaagagtcttctatcccggaacgtccggctttggcgggatttgaaagaccgaaagcaaaatccgccaagcaggccgtattcatcgcgacctctacaggcggaccgcgggctctgcaaaaggtggttccgaaactgccgaaggatttaaaggcgcctgtatttgtcgttcagcacatgcctgaaggcttcaccgcttcacttgcagacagactcaaccatttgtcagatattcaggtcaaagaagcggaaaacggtgaagaagcgaaagacggatgggtgtacatcgcgcccggcggaaaaaatatgacggttgcagaggaaggcggaaggctccgcatcattcttgatgttcatgatacggaaagccggcataaaccgtcagccgattatttgtttcggtcggcaagccgtttatccggttacgaaaaggtagccgtcattatgacaggcatgggcagcgacggaaccgagggcgtaaaagaaatgctcagaacaggcggcgttaaaacgattgcggaatcggacgaatcctgtgttgtgtttggaatgccgaagtcagcgataaaggcgggcctcattcatgagattaaacatgtggaagatatcgcggcatccatcaccggatgtgtgaaaaaagagagggtgtgaatcaattggatatgaatcaatatttagatgtctttattgatgaaagtaaagagcacttacagacatgtaacgaaaagctgctgctgttggaaaaagatccggcagaccttcagcttgtgcatgacatcttcagagctgcccatacgctgaaaggcatgagcgcaacgatgggatatacagatctggcgcatttaacccacctgatggaaaatgtgctggacgccatccgcaacggagaaatgcccgttacatcggattggctggacgtgctgtttgaagcgcttgatcatcttgaagagatggtgcagtccattattgacggaggagacggcaaacgtgatatttctgaagtaagtgcgaagctcgacgtaaatgcggcgcatgagactgcggcttcagccgaaacagcagaaccgccggcttcaaaacaacagacttcaactgaatggaattatgatgagttcgaacggactgttattgaagaggcggaagagcaaggattcagccgctatgaaataacggtttccctgaatgaaagctgcatgctcaaagccgtgcgcgtgtacatgatatttgaaaagctgaatgaagccggggaagttgcaaaaacgatacccgccgcggaagtgcttgagacggaagatttcggaacggattttcaggtgtgtttcttgacaaagcagcctgctgaagaaattaaagaactcatcagcggcatttcagaagtggagaatgtcgaaatttctgccggtgcgccgttaaaaacggccgaaaaaccgcaagcagctgaaccggtgaaggaaactccggttaaaaaggctgaaaaacagccgaaaccgcaagcgaaaacggaagagcagccgaagcatcacagcggctcgaaaacgattcgcgtcaacattgaaagactggattcttcaatgaacctttttgaagaacttgtcattgaccgcggacgtcttgagcagatcgccaaagagcttgaccacaatgagctgactgaaaccgttgaacgcctgaccagaatttcgggcgaccttcagtctattattcttaatatgcggatggtgccggtagaaaccgtctttaaccgtttcccgagaatgatccgccagcttcaaaaggaattaaacaagaaaatcgaattgtccatcatcggagctgaaacggagctggaccgcacggtgattgatgaaatcggcgatccgcttgtccatttaatcagaaacagcatcgatcacggcattgaatcgcctgaagtgcgggtgaataaaggaaaaccggaatcgggtcatgtcgtgcttaaggcatatcacagcggcaatcatgtctttattgaagttgaagatgacggggccggcctgaacagaaagaaaattcttgaaaaagcgctcgagcggagtgtaattaccgaacgtgatgctgaaacgcttgaagataatgagatttacgagcttatttttgctcctggcttctcgactgccgatcaaatttctgacatttcaggtcggggcgtcggtctggatgtcgtaaaaaataaactcgaatcactcggcggctctgtcagtgtcaaatccgcggaaggccaaggttctcttttcagtatccagcttccgctgacactttcaattatatccgttcttctcattaaactggaagaagagacgtttgcgataccgatttcttctattatagagacggctgttattgataagaaagatatcctgcagacgcatgacagagaagtgattgatttcagaggacaaatcgttccgatcgtctatctcaaaaaagaattcggcattacagattcaaaacaggatgccgatcagttccatgtaatcgtcgtgaaaaagggcgataaatccactgcttttgtcgtggactcttttatcggacagcaggaagtcgtactgaaatcactcggcgactatttgacgaacgtctttgcgatttccggcgctacgattctcggaaacggagaagtggcgctgattattgattgcaatgcgctgatctactaaaacgacacgaggaggtgcccgcatgactgctgaaatcaaaacaggtgaaaaaatgattgtgtttatgataaacgggaaagaatacgctatctcagtttcccaggtgaaatcaattgaaaagtggcaaaaaccgacgagggtcccgggtgtggaatcgtatatccgcggcgttatcaatctgcgcggagtaattaccccggttcttgatttaagaaaacgtctgaaccagcctgaacaggacatcacagaagagacacggattatcatcatttcttaccgtgacgccgatgtcggatgggtcgtggatgaggccaatgacgtcatcaccgtgcatgaaaatgaaatcgaatccgcgcctgaaagccagacaaaggaaacggatgtgtggattaaacagatcgtcaagcaagataacaggctcctcaatattattgatgcgcatgcggtgctggataaaggtgcttcggcatctgcgtccggagagccgaatgcttaaaggggaaaagacaacatgagtaagtttgaagcgatcaaagaagagcagatggatattttgcgggaagtcggaaatatcggggcgggtcactcggcttctgccatggctcagctgctgaacagaaagatagacatggaagtgccgtttgcgactttattgacatttgatgagctcgctgattttttcggcggggctgaaacgccggtcgccagtatctttttaagaatggaaggcgacatgacaggctctatctttctcatcatgcctttccatcaggcggaacagtttatcagagagctgatcggaaatccggattttgatattgaccagttgggcgaagatcatttgagttcttctgctttacatgagttcggcaatattttagcaggttcctatttaacggcattggctgatttgacaaagcttgagatttacccgagcgtgccggaaatctcacttgatatgttcggcgcggttatcagtgaaggactgatggagctcagccaagtcggagagcatgccattgtcgtggatacttctatttttgaccagggcagccggcaggagctcaaagcccatatgtttatgctcccggactatgattcttttgaaaagctcttcgtctcattgggtgcggctttatgagccgtgcggaagccgcagtcgttaaagtggggattgcggatgttcaagtcgcgcgttatccggataaaatccggacttcgggactcggttcatgcgtggggctggttttatacgataaagacaaacaaacggcaggactcgttcacgtcatgctgccggactccggtttatcaaaaacggcggagctcaaccgtgcaaaatacgcggacaccgccgttaagatgacaattgatatgcttttgaaagccggctgccgcaagtttgccctgaaggcaaaactcgccgggggagcggagatgtttaagtttaaaatgacaaacgacctgatgaaaatcggtccgaggaatgtagcggctatcaaagagcagctttcattgtataacattccggtcatcagtgaagatacgggcggctcaagcggccggacgattgaatttgagccaaagtcctgcatgctgcacattcgaactgttaaacaaggtgaaacaacgatttaataaaggtatgaggtagggggataacaatgcaatccttgaattatgaagatcaggtgctttggtcgcgctggaaagagtggaaagatcctaaagccggtgatgatttaatgcgccgttacatgcctttggtcacatatcatgtcggcagaatttccgtcggactgccgaaatcggtgcataaagacgatctaatgagccttggtatgcttggtttatatgatgccctagaaaaatttgaccccggccgggatttaaaatttgatacctatgcctcgtttagaattcgcggtgcaatcatcgacgggctgcgtaaagaagattggctgcccagaacttcacgggagaagacaaaaaaagtcgaagcggcaatcgaaaaacttgaacagcgctaccttcggaatgtgacgccttcagagatcgcagaagagcttgggatgacggagcaggacgtagtatcaacgatgaatgaagggttttttgccaatctcttatcaattgatgaaaagcttcacgaccaggatgacggtgagaatattcaagtgatgatcagagatgacaaaaatgtgccgccggaagaaaaaatcatgaaggacgagctgatcgctcagcttgcgggcaaaattcacgagctctctgaaaaagagcagcttgtcgtcagtttattctataaagaagaactgactttgaccgaaatcggacaagtcctgaacctttcgacgtcgcggatttcacagattcattcaaaggcgctgtttaaattaaagcacctgcttgaaaaagtaattcaataatgaactcatggttagcgagtgaaaaacatgtcaacactattatggcttttaagctttgtgcttcacggcgtactgctttatgccgtcattattctgtacacgaggttttcagccctcaaggagacggagcgccagcagaagaagattcttgaagagacggaaaacacccttgcagcgtttctgcttgagctgaaagaagaaaatgaaagactcgaagacacaaaaagccggaatgatcaagcgcctgacgcagaagacgccgaaccccggccggaaccgaaaaaagagcctgatattccggatcacatggaaaagctcatcagtgcaacggaacgggctgaaagtgacgaaaacaacggtgcgcattcgtttgaagaacgtgtttcagaattatatgaacaagggctcacccctgcggaaatcgccaaacgggtgcagagcggaaagacagaaatcgagctgtttttaaaatttcgcggcaaagctgtaaaggattcttgattgtcgcataaagctgtgttatattatgtcttggtgttaaatacacacgcttaacgatttatgcagagggtgctgcaaacggcagttctgcacaaaaatgacctaagcggaggaaaaaaaccattttattaggaggaaatcacatgtcagttatttctatgaaacaattgcttgaagctggtgttcacttcggccaccaaacacgccgctggaacccaaaaatgaagcgttacattttcacggagcgtaacggaatctacatcattgaccttcaaaaaacagtgaaaaaagtagaggaagcttacaacttcacgaaaaaccttgctgctgaaggcggaaaaatccttttcgtcggcacaaaaaaacaagctcaggattctgttaaagaagaagctgtacgctctggcatgtactatgtcaaccaacgctggttgggcggtacactgacaaacttcgaaacaatccaaaaacgcattaagcgtctgaaagacatcgagaaaatgcaagaaaacggtacatttgaagtacttccgaaaaaagaagttgttcaattgaaaaaagaattagagcgtcttgaaaaattcctcggcggaattaaagacatgaaggatcttcctgatgcattattcatcatcgatcctcgcaaagagcgcatcgctgttgcggaagctcgcaaattgaacattcctatcatcggaatcgtagatacaaactgtgatcctgatgaaattgatgtcgtaatccctgcaaacgatgacgcaatccgcgctgtcaaacttcttacttctaaaatggcagatgccattcttgaagcgaagcaaggcgaagaagaagcggaagctgctgaagagactgcacctgaaacagaaacgacaactgcgtaacctaatcaaaaggtgataagagggactgccttttatcaccttttttcaagaaaaatgtatctatacatatcttgtttacacatataaggaggaattcaaatggctattactgcacagcaggtaaaagaactgcgtcaaaaaacaggcgctggtatgatggactgtaaaaaagcattgactgaaactgacggagatatggacaaagcaatcgaccttctgagagaaaaaggaattgcgaaagcggctaaaaaagctgaccgtatcgctgctgaaggttctactcttattaaaactgacggcaacaaaggcgttatcttagaagtaaactctgaaactgatttcgttgcgaaaaacgaaggcttcaaagagcttctgaacacgcttgctgaccaccttcttgcaaacgctcctgctgatcttgaagaagcgttgggtcaaaagatggaaaacggttctactgttgaagaatacatcacaagcaatgttgctaaaatcggagagaaaatcactcttcgccgttttgctgttcttacaaaagaagacagcgaagcgttcggtgcttaccttcacatgggaggccgcatcggcgtattatccgttcttagcggaacaactgacgaagatcttgcaaaagacatcgcgatgcatgttgcagcggtaaatcctcgttatatttcccgcgaccaagtgtctgaagaagaagcaaaccatgagcgtcagatcctgactcagcaagctcttcaagaaggcaaaccggaaaacatcgtagctaaaatggttgaaggccgtctgaacaaattcttcgaagaaatttgcttattagaccaagctttcgttaaaaacccagacgaaaaagtgaaacaagttgtggctgcgaaaaacgcatctgttaaaacttacgtccgctacgaagttggagaaggcattgaaaaacgccaagaaaactttgctgaagaagttatgaaccaagtgaaaaaataatggcggaaagccttggcgaatctttcgcggcttttcaggcagtataggggacactacttgtgttccctatttttaaaactatatttacaaacctttttttctcttgcataataggaaacggcaatgtttacacttggaggttattatggaaaaaccaaaatacaatcgtatcgttttaaagcttagcggagaagcattggcaggagagcagggaaacggcattaatccgactgttatccaatccatcgctaaacaggtaaaagaaatcgctgagcttgacgtcgaagtggccgtagttgtaggcggcggcaacttatggcgcggaaaaacaggcagtgacttaggaatggaccgtgcgacggccgattatatgggcatgcttgctactgtcatgaactcacttgccctgcaggacagcctggaaacgctcggaattcagtccagagtgcagacatcaattgaaatgcgtcaggtcgctgagccttatatcagaagaaaagccatccgccacctggagaaaaaacgcgttgtgatttttgccgcgggaacgggaaacccttatttctctacggacacaaccgcagcgctgcgtgccgctgaaatcgaagcggatgtgattttaatggcgaaaaataatgtcgacggtgtgtataatgccgatccgagaaaagatgagtcagctgttaaatacgaaaaattatcttatctcgatgtgttaaaagacgggctggaagtcatggattctacggcttcttcactatgtatggataatgatattccgctgatcgtcttttctattatggaagaaggaaatattaagcgtgccgtaatcggcgaatcaatcggaacgatcgtaagggggaaataacgttgtcaaacgaagtattaacacaaacaaaagaacgcatggaaaaagcggttgccgcttattcacgtgaattggcgtcagtccgcgcgggacgtgccaacccatctctattggataaagtgacagtagaatactacggtgcccaaacacctttaaaccagctgtcttccatcaatgtgcctgaagcgcgtatgcttgttgtcacaccgtatgacaaaacggcaatcggcgatattgaaaaagcgatcctgaaagctgaccttggcgtaactccgacaagtgacggcacaattattcgcatcgcgatcccggctctgacggaagaaagacgtaaagaacttgtcaaagtcgtgaaaaaatacgcggaagaagcgaaagtagcagtccgtaatgtccgccgtgacagcaacgacgacctcaaaaaacttgagaaaaacggggacattacagaagacgagcttcgtgcttccagtgaagacgttcaaaagctgacagatgaatatgtgtcaaaaattgacagcgtcacgaaagacaaagaaaaagaaatcatggaagtttaatgaaaaactatgtacaatagataatgtgaaaagaccctctcatgtttacagggggtttttttgttaatactgttgattacattgatcatcagcaacgcaacctttttgggtgacggaggaatctcatgctcaacatactcaaaaattggaagaatcagcagaatgcggcttccaacttagaacggtatacaaaagaagacatactgaagggtgaaattcccgcacacattgccattattatggacggaaacggacgctgggcgaagaagcgctcactcccgcggattgccggacatcatgaaggaatgaaagtggtaaaaagggtgacaaagctcgcaaatcagctcggcgttaaagttctgactctttatgcgttttcaacggagaattggaagcgaccgaagatggaagtcgactttttgatgaagcttccggaagagttcctgaatacgtatcttcctgaattgatagaggaaaatgtacaggtgaaaattatcggagatgaatccgcgctcccttctcatacgtacagggcgattgagaaggccgtaaaagatacagaacaaaatgacgggctgattctcaatttcgctttgaactacggcggacgcacggaaatcgtcaatgcggcaaaagcattggccgaacaggtgaaaagcggcacgctgaatatcgaagacattgatgaagcgctcttttccgggcatttaatgacagaatcaatccaggacccggaactgctcatcagaacgagcggagaaatcagactgagcaactttatgctttggcaggtggcttacagtgaatttgtttttacagatgtcctgtggcccgattttaaagaagatcactttctgcaggcagtgggagaatttcagcagcggggccggaggtttggcggaatttagaggatggtggaaatgaaacaaagactgttaacaggtgttctggcagcggcactatttttatttttggttattttcggaggattgccgttcaccgtatttgtttacgtgatgggaagtatagcgctttttgagcttttgcggatgaaaaagctcagatttttttcttttccgggtctgatcagcttcttgttgttatggctgtatatgatgccggacaaatatcattttttcgatgcgaaaatggaagtaacgattttcgccgtattgattctgctcagctatacggtgctcgtgaaaaacacctttacgtttgacgaagtcgggtttatcgttctcgcgacggtatatatcggactgtgttttcattattttattgaaatcagaaacattgaaacaaacgggcttttgtatatcttttatgcctgcgttgtcatatggtcaacggactcaggcgcatatttcgtcggaaagtcgctcgggaagcggaagctgtggcccgaaatcagtcccaacaaaacagtggaagggtttctcggcggtattgtcatcgcccttatttttacggccgtttttcagctgtttgctcaccttccgatttcatatccggttcttttggtcatcacgcttgttctgtctgtgttcggacagatcggggatttggttgaatcagcgcttaagcggcactatgatgtgaaggattcggggaaaatccttcccgggcacggcggcattttagaccgatttgacagctttttgtttgtcatgccgttcttatactttctgcttgcgcttttttcatgagaaaggctaatatgaaaataagaccgatctggacgcatagaatgggagtggcattttgaagaatatttgtcttttaggagcaacaggatcaatcggggagcagacgttagacgtattgcgcatgcatcaagatcagttccgtctcgtctcgatgactttcggtaaaaacgccgagaaagcgatcccgttgatcagaacgtttcagccgaaatatgtagcagtcggcgacatggatacatatcaaaaagtgaaagaagcgtctttttcgcatgaatgtcaaatcggcatcggagaagaaggcctgattgaagcggcagtcatggacgaagtggatatcgtggtcaatgcgctgcttggaagcgtcggtttaatcccgactttgaaagcgattgaacagaaaaaaacaattgcgcttgcaaataaggaaactctcgtcactgccgggcatatagtgaaaggacacgcaaaacgatacggtgttcctcttcttccggttgacagcgaacattccgctatttttcaggcgctgcaaggcgaacagagcaaaaatatcgagcgcctgatcattacggcatccggcggcagtttcagggataaaacgcggcaggagcttgagtctgtaacgattgccgacgcccttaatcacccgaactggtcgatgggtgcaaagattacgattgactcggctacaatgatgaataaagggcttgaagtcattgaagcgcattggctgtttgacattccgtatgaacagattgacgttgtattacataaagagagcatcattcattcgatggttgaatttcacgacagaagcgtcatcgcccagctcggaaatccggacatgagggtgccgattcaatacgcgctgacatatccggaccggctgcctctgcctgaaacaaaaaggcttgaattatgggagatcggaagccttcattttgcgaaagctgactttgaaaggttccgctgcttacaatttgcctttgaatcaggtaaaatagggggaacgatgccgacggttttaaatgcggccaacgaagaagccgttgccgcttttcttgccggacggatttcattcttatcgattgaggacctgattgaaaaagcattggaccgccacagcgtaattcaggatccgagtcttgcggatatccaagaagtggacaaagacacccggggatacgttaattcaatactcacataaggtggtatgttcgtgaatacagttatcgcgtttattattattttcggaacgctcgtttttttccatgagctcgggcatttattgctcgcccaaagagcgggaatcctttgccgtgaatttgcgatcggcttcggccctaaaatcttttcatttaaaaagaatgaaaccgtgtatacgatcagactccttccggtcggagggttcgtccgcatggccggtgaagacccggagatgatcgaagtcaaacccggttataccgtcgggcttctttttaataaagatgacgaagtggaaaaagtcatcattaatcaaaaggaaaaatatcccgacgctttaattatcgaggtggagacggctgatcttgagcacgaaatgaagattaccgggtacgagcaggggaaagaagatgaactggcgggctttactgtcagtcagacctctttttttatcgtagacggagaagaagtgcagattgcgccttacaatcgacaattcgggtctaaacccgtatggaagcggattaaggcgattgctgccggtccgataatgaacttcatcttagcgtatgtcattctcgtcatgctcggattcattcaaggcgtgccttcaaatcagcctgagctcgggaagctgacagacaatggacgcgcagctgctgccggtttaaaagaaggcgactatatccagagcattaacggtgaaaaaatgaggtcatggaccgacatcgtgacagcggtaaaagaaaatcccgggaaaaaaatcgatgtcgccgtcaaacgggacggcaaatcgtttcatatctcggttacacctgaagctgtaaaagatgaaaataaaaaaacaatcggccgcttcggctcttatgcgccgactgaaaaaggagcgcttgcagcgattgcttacggcgcgacatctaccgttgatgtcacaaaagcgatcctgaccaatctgagcaaacttgtgacaggccagtttaagcttgatatgctttcgggtcctgtcggcatttatgatatgacggatcaagttgcaaaaaccggtattatcaacctattccagtttgcggcgtttttaagcatcaacctgggaatcgtcaacctgctgccgataccggcgcttgacggcggacggctgctgtttttattcattgaagcaatccgcggcaagccgataaaccgtgacaaggaagcatttgtcgtatttatcggcgtagctttcttaatgcttcttatgctggttgtcacatggaacgatatccagcgtttattcttataattgactagtaaaaaatcagaggtgcgaagacatgagacaaagtttgacgcttattccgaccctgagagaagtgccggctgatgctgaagcaaaaagccataagcttctgctgagagcgggatttatcagacaaaatacgagcggggtttacagctacatgcccctggcttacagggtcattcaaaacattcagaagatcgtgcgtgaagaaatggaaaaaatcaacgcggtggaaatgctgatgccggcccttcagcaggctgaaacatggcaggaatcaggcagatggtatacgtacgggcctgaattaatgcgtctgaaagaccgccacggccgtgaatttgctttaggcgcgacacatgaagaagtcattacttctctcgtgcgtgatgaggtgaaatcttataagcgtctgccgctcactctttaccagatccagtctaaattcagagatgaaaaacgcccgcgtttcgggttattgcgcggacgcgaattcatcatgaaagatgcgtattctttccatgcttctgaagaaagtctggaggaaacgtaccaaaacatgtacggcgcatacagcagcattttcgcacgctgtgaattaaacgtccgtcccgttattgccgactcaggcgcgatgggcggaaaagacacgcatgaatttatggctctttctgaaataggggaagataccatcgcttattccgatggatcctcttacgcagccaatacggaaatggcgaaagttgtcatgaacagcgagccgtcagatgaaacacccgaggcattggagaaaattgatacgccaaatgtcaaaagcattgaagagctcgcttcgttcttgcagatcgagccgagcgcctgcatcaaatcaatgctgtttaaagcggatgaccgatttgttctcgtgttagtaagaggcgatcatgaggtcaacgacgtgaaagtgaaaaaccttctgaacgcggaagtggttgagcttgcgtctcatgaagaagtagcggagaaacttggcacggagccgggatttgcggggccgatcggcgctgccggcgacattgagatttatgccgaccaagccgtgaaagtaatggtaaacgccgtttgcggcgcgaatgaaaaagaccgtcattaccgaaacgtaaacatcgaacgtgacgcgtctgtaaaagcgtatgccgatcttcgaatcattcaggaaggcgatccgtcacctgacggaaaaggcacgatccgtttcgctgaagggattgaggtcggacaagtctttaaactcggcacgcgttactctgaagcgatgaatgcgacataccttgatgaaaacgggcgtgcgcagccgatgctgatgggatgttacggaatcggcgtgtccagaacgctttctgccatcgctgaacagcatcacgacgaaaaaggcttgatctggccgaagagcgttgctccgtatgatcttcatattttggcgctgaatatgaaaaatgaagcgcaaaaagagcttgctgaacagctttacggaaaattccagacggaaggttatgaggttttatacgatgaccgcgctgaacgcgcaggcgtgaagtttgctgattctgatctgatcggccttccgatccgcatcactgtcggaaaacgtgccgacgaaggcatcgtagaagtgaaaatccgcaaaaccggtgaatctgctgaagtttcagtggatgagctttctgaatttattaagacgaagtaatcaccataacgaatcgtacaaaatcatgttaaaatagagaaaaaagaaggtacctcatcacctgcggaggtaccttcacttatgatgttttaagggagggatactgtctgaatggaacagttatcagtaaacagaagacagtttcagattcttctgcagcagcttaatatgacagatgataccttcatgacatactttgaagacggagagattgataaactgacaatccataaagcagaaaaagcctggcatttccaatttcgctttaaggctcttttgccgtatcaaatatacgattcattcatgatgaggttaacacaatcgtttgctcacatcgcccgtgtcacatcgtctgttcaggtcatcgatcctacagtgacagaggagcttgtacaggattattggacacgctgtattgaagagcttgaaggaacctcgccgccgatggtggctcttttgaatcagcagaagccgaagctcaagggaaacaaactgatcgtgaaaacaaaaacagatacagaagcatcggcgctcaaaaataaatacagcgcactgattcagcacagctatcgccaattcggatttccggaactgcagctggataccgaaattttcgtatctgaccaagaagtccagaaattccgcgagcaaaagcttgctgaagatcaggagcgggcgatgcaggcgcttatcgaaatggagaagaaggaaaaagagggcgatgaggatcaagcgccgtccggcccgcttgtcatcggctatcaaattaaagagaacgaagaaatccggacgcttgacagcatcatggatgaagaaagaagaatcacggtgcaggggtttgtgtttgatgctgaaacacgcgagctgaaaagcggacgcacgctctgcattttcaaaatcacggactatacaaacagtattttagtaaaaatgttcgccagagaaaaagaagacgccgctttgatgaaaacgctgaaaaaaggcatgtgggtgaaggcgcggggaagcattcaaaacgatacattcgtcagagacctcgtcatgattgcaaatgacgtgaatgaaataaaagccaaaacccgtgaagacaccgctcctgaaggcgaaaaacgggttgagcttcatctgcattctccgatgagccaaatggatgctgtaacgggcatcggaaagcttgtcgaacaggcgaaaaaatggggacatgaagcgattgcgttaactgatcatgccgttgtgcagtctttcccggatgcctattccgccgcgaaaaaacacggcattaaaatgatttacggaatggaagccaatatcgtggatgacggtgttccgatcgcatacaatccagctcaccgtcttttggaagaagacacatacgtcgtctttgacgttgaaacgacaggtctgtccgcagtgtatgacaccatcattgagcttgccgcagtcaaaataagaggcggagaaatcatcgataaattcgaagcgttcgccaatccgcaccatccgctgtcagcaacgacgatagagcttaccgggattacggatgacatggtccgcgacgctcccgatgtcgttgacgtcgtccgggattttaaagaatggatcggcgatgacgtgcttgtggctcataacgccagctttgatatgggatttttaaatgtggcgtacaagcgtctactgaaaacggaaaaagcgaaaaatccagtcattgatacgctggaactcgcgcgtttcctgtatcctgagtttaaaaatcaccgcttaaatacgttatgtaagaagtttgatatcgaattaacccagcatcaccgagcggtctttgacgctgaagcaacgggctacctgctgttgaaaatgctcaaagatgccgctgaaaaagacattttttatcatgatcagctgaatgagaatatgggacaatccaatgcttatcaaagatcaaggccttatcacgctacattgcttgccgtaaatgagaccggccttaaaaatctgtttaagctcgtgtctatttctcatattcaatatttctacagagtgccgcgcattccgaggtcgcagcttaataaatacagagaaggtctgttaatcggctctgcctgtgacaggggagaggtctttgaaggcatgatgcaaaaatcacctgaagaggttgaagatatcgcatcattctatgattatcttgaagtgcagccgccggaagtatacagacaccttctgcagcttgagctcgtccgggatgaaaaagcgctgaaagaaatcatcgccaacatcacgaagctcggggaaaaattgaataagccggtcgttgccaccggaaatgttcactatttaaacgatgaggacaaaatttaccggaagatcttaatatcttcccaaggcggcgccaacccgttaaacaggcacgaactgcctaaagtgcacttcagaacgacagatgaaatgctggatgctttctcctttctcggtgcggaaaaagcgaaagaaattgtggttgacaatacgcagaaagtcgcttcgatgatcaatgagatcaaaccgatcaaagacgatctgtacacgccgaaaattgacggagccgatgaagaaatccgtgaaatgagctatcagcgcgccagaagcatttacggtgaagagcttcctgaaattgtggaagcgagaatagaaaaagaattaaaaagcatcatcggtcatggattcgccgttatttatctcatctcccataagcttgtaaaacggtctctggatgacggttatctcgtcggctcccgggggtccgtcggttcatcgcttgtggcgaccttaacggaaattactgaagtgaatccgctcgctccgcactatgtgtgcccgagctgccgatattcggaattctttaatgacggatcagtcggttccggttttgaccttccggataaaagctgcccgtcttgcggcacacctttgaaaaaggacgggcatgatatcccgtttgaaacgttcttaggctttaaaggtgacaaagtacccgatatcgacttgaacttctcaggtgagtatcagccccatgcccataactacacgaaagtgctgttcggtgaagataacgtgtatcgcgcgggaacgatcggcaccgttgcggaaaagacggcttacggatatgtgaaaggctatgcgggtgatcacaacctacacatgcgcggcgcggagatcgaccgtctggtgcagggctgcaccggcgttaagagaacgaccggccagcacccggggggattatcgttgtcccggattacatggatatttacgatttttccccgatacaattcccggcagatgcgacggggtctgaatggaaaacgactcattttgacttccactccattcatgacaacctgctgaagcttgatatattggggcacgatgacccgacagtcatccggatgctccaggatttaagcggaattgatccgaagacgattccgacagatgatccggaagttatgaagattttccaaggtacagaatcgctcggcgtcactgaagagcagatcggctgtaaaacggggacgctcggtattcctgaattcgggacgcgatttgtgcggcagatgcttgaggatacgaagccgacgacgttctccgagcttgtccagatttccgggctttcccacggcacggacgtatggctcggcaacgcgcaggaactgatacacaacaatacgtgtgaactgagcgaagtgatcggctgccgtgatgacattatggtttacttgatttatcagggccttgagccttcactggcctttaaaatcatggaattcgtgcgtaaaggcaaaggcctgacgccggaatgggaagaagaaatgaaaaagaacaatgtgccgaactggtatattgattcatgcaaaaaaatcaaatacatgttcccgaaagcccacgccgccgcatacgtgctgatggcggtgcggattgcctattttaaagtgcatcacgcgcttttatattatgctgcgtattttaccgtccgcgcagatgactttgacattgatacaatgattaaaggctcgaccgccatcagagcggtgatggatgatatcagctctaaagggcttgatgcttcgccgaaggagaaaaacctccttaccgtgttagagcttgcgcttgaaatgtgtgagcgcggctattccttccagaaggtcgatctataccgttcgagcgcttcggaatttatcattgacggcaacagtctcatcccgccgttcaactcaattccgggactcggaaccaacgccgctctcaatattgtgaaagcacgggaagaaggggagttcctttcaaaagaggatcttcaaaaacgaggaaaagtgtcaaaaaccattttagagtatttagaccgtcacggctgtcttgagtcgcttccggaccaaaatcagctgtctctgttttaagctttgtgcacagcctccgagcggagtttgatttgcattaaatatatggttatggtatagttttattggaaatgctaacgattaccgaggcaaagagtggggaaacccgctcttttgtattgaacaggcaattttgcctcgacatgtccatcgttttctcaatgcccctgctcttttgaagcagggtttttatgcagaggaacggctgatatgatatcgacagcacaaggaggaaaaacatgagcaaaaaagtgactgataccgttcaaggaatggctcagcccatactggatgaccttcagcttgaactcgtagacattgaatttgtcaaagagggtcaaaactggttccttcgcgtgtttattgattccgataacggtgttgatattgaggagtgcgccaaagtcagcgaagcgttaagcgaaaagctggatgaggccgatccgatcactcagaactactttcttgaagtatcttctcctggagccgagcgtccattaaagaaaaaagccgacttcgaaaaatcactgggcaaaaatgtgtacatgaaaacgtacgaaccgattgacggtttaaaagtgtttgaaggcaaattggctgaatttgatggacaaactgttacaatagagatgacggtcaaaacaagaaagaaacgggtcaatattccgtatgaaaaaatagctaacgcaagattagctgtaacattttaatgaatgaagtattagtgtttaaggggggagaccgctaacatgagcagtgaactattagatgctctcactattcttgaaaaagaaaaaggcatcagtaaagacattatcatcgaagcaattgaagctgccttaatttccgcgtataagcgaaattttaaccaggcgcaaaacgtacgggtcgatctgaaccgtgagacgggcacgattcgcgtgttcgcaagaaaggatgtcgtagacgaggtatacgattcaagacttgaaatctcgcttgacgacgcccagcacatccatccgaactaccttgtcggagatgtcgttgaaatagaagtaacgccgaaagacttcggccgcattgctgcgcagacggcgaaacaagtggtgacgcagcgtgtccgtgaagctgagcgcggcgtgatttactcagaatttatcgatcgtgaagaagacatcatgacgggaattgtacagcgcttagacagcaagtttatttacgtgtctctcggcaagattgaagcgctgctgcccgtcaatgaacaaatgccgaatgagagctataaaccgcacgatcggattaaagtatttatcacaaaagtcgaaaaaacgacaaaagggccgcagatctatgtatcaagaacgcatcctggtctgttgaagcgtctttttgaaatcgaagtgccggaaatttatgacggaacggtcgaactgaaatccgttgccagagaagcgggcgaccgctctaaaatctccgtccgcactgatgaccctgacgttgatccggtcggttcatgcgtcggtcctaaaggccagcgggtgcaggcgatcgtcaatgaactgaaaggcgaaaaaattgatatcgtcaactggtctgatgatccggttgaatttgttgccaatgcgctcagcccgtctaaagtactggatgtcatcgtcagcgaagaagaaaaagccacgactgtcatcgttcctgattaccagctttctctggcaatcggaaaaagagggcaaaacgcccgcttagccgcgaaactgacaggctggaaaatcgatatcaaaagtgaaacggatgcaagagaccttggcatctatccgagagagcatgaagaagatgacgatttagagccgctctttatggagcctgaaacagccgaatcggatgaataagaggtgactttaggtgaataagcgaaaaaaaattcctctgcgcaaatgcgtggtaacgggggaaatgaagcctaaaaaggaactgatccgaattgtccgttctaaagaaggagagatttcagtcgatccgaccggaaagaagaacgggcggggtgcctatatcacccttgagaaagaatgcatcttagctgcgaaaaagaaaaacacattgcaaaatcaatttcaatcacaaatcgatgaccagattttcgaagaattgctggaactggcggaaaaggtgaaaaaataacatgtctggaatggaatggtttcccttgctgggtctggccaatcgagctcgtaaggtcgtgtcgggcgaggacttggttataaaagaaattagaaatgcgcgtgcaaaacttgttctgctgacagaagatgcatctgcgaatactgcaaaaaaagtatccgataaatgcaattattataaagtgccttataaaaaagtcgaaagccgcgcggatctcggccgctctatcggcaaggaatcacgtgtcgttgtcgccgtcactgaccaaggttttgcgaataagctgatcagcttgctcgattaatatttttgggggtgaacgaatggctaaaatgagagtttacgaatatgcaaaagccatcaatgtttcaagcaaggaaattttgactgcgctgaaaaacatggatatagtagtaaataaccatatggcaatgcttgaagaaaagaccattaagcagcttgatgcgaaatttaaaaaaggcggcgccggcgttacatctcagaagcctgcggaaacgaacaaaaacaagccgcaagggattaatcagcagcctgctgggaatcaaccaaacaaaattcgagacggaaagaagaatgacgtgcagaataatcaatttaacaaaaacaagaagaataacaacaacaacaaaaacaaaaacaaacgcaatcataacaacaaaaatcagtatcagcaaaaaccgctgaagccgaaaaaagagcttcctgagaaaattacgttttccggctctttaacagtcggggccttagccgaagaacttggcaaagaaccgtctgaactcattaaaaaactgatgcttctgggtgtaatggctaccattaaccaggagcttgacaaagacacaatcgaactgatcgcatctgaatacggtgtggaaacagaagaagtgattgtgcttgaagaaactgagcttgaaaaatatgaagaggctgacaaagaagaagatcttcaaatccgtccgcctgtcgtgacgatcatgggccacgttgaccacgggaaaacgaccctccttgacagcatcagaaaaacaaaggttgttgaaggtgaagccggcggaatcacccagcatatcggggcgtaccagatcgaagaaaacggcaaaaaaatcacgttcttagatactccgggacacgcggcgttcacaacaatgcgtgcgcgcggtgcggaagtaactgatattaccattttagtcgtagcggctgatgacggcgttatgccgcaaacagtcgaagccatcaaccatgcgaaagcggctgaggttccgattatcgttgccgtgaataaagtggataaagaaagcgcgaaccctgaccgtgtcatgcaggagctgactgaatacggactcgttcctgaagcatggggaggagaaacgattttcgttcctctgtctgctcttacaggcaagggaattgacgagcttgtcgaaatgattctgcttgtcagtgaagtggaagagctgaaagccaatccgaaccgtcaggcaaaaggaacggttattgaagctgagctcgataaaggaagaggatctgtcgcaacacttctcgttcaaacgggaacattgcatgtcggagatccgatcgttgtcggaaatacattcggccgcgtgcgggccatggtcaatgatctcggccgccgcgtgaaaacagccggaccgtccacacctgtagaaatcacgggcttaaacgacgtaccgcaggctggcgatcaattcctcgtctttaaagatgaaaaaacagcccgttctgtcggtgaagcacgcgcttccaagcaactggaagaacagcgcagcgacaaagcgaagctgagcctcgatgatctgtttgaacaaattaaacaaggcgatgttaaagacatcaatttaatcgtaaaagctgacgttcaaggttcagccgaagcgttaacagccgctcttcaaaaaattgaagtagaaggcgtaaaagtgaaaatcattcacacaggcgtcggtgcgattacggaatcagacatcattctcgcatcagcttcaaatgcaatcgttatcgggtttaatgtgcgcccagacggaaatgctaagagcacggctgaagctgaaaatgtagatatccgtcttcaccgtatcatttacaaagtcatcgaagaaattgaagcggcgatgaaaggaatgcttgatcctgaatacgaagaaaaagtcatcggtcaggttgaagtgcgccaaacattcaaagtgtcgaaaatcggcacgattgccggcggatatgtaacagacggccacattacacgtgacagcggactccgcctgatccgtgacggcgtggtcatcttcgaaggggaagtagacgttctgaaacgcttcaaagatgatgtgaaagaagtttcacaaggatatgaatgtggtataacgattaagaaatacaatgacattcgcgaaggcgacgtccttgaagcgtatgtcatgcaggaaatcgaaagaaagtgatcggatttgcggaatgtgaatgcatcatttatgatgcgggatcattaaaggagaaacgagccgttctgaagcggattataacgagggttcagaataagttcaacgtgtcggccgcagaaatcggctatcaggacacttggcagcggaccagcttcggaatcgctgtcgtctcttcctctcacgttcaggcggaaaaggagatccagcgcgtactcgcgtttattgactcctttcccgagatagaacggacgatcactagaacagagtggttttaacttagaggtgattgaattgagtatgagagcaaaccgtgtcggcgagcagatgaaaaaagagctcggggatattatcagccgaaagctgaaagacccgagaatcggatttctcactgtaacagacgtacgtgtttcaggtgatttgcaaatagcgaaggtgtatatctccgttctcggcggagagaaaaagaaagaagaggcgctgaaagggcttgagaaagcgaaaggatttatccgttccgaaatcggcagccgaatcagactccgcaaaacgcctgagcttgaatttgaatttgatgaatcaattgagtacggcaatcgtattgaaacattgattcacgaactgcattcagataaaccgtctgaataacgggaaagaggatgggcgagtgtcgtctgtcctcttttctgcgttttacgggatacaattgataacaaaggagcgaaagacagatggttaacggagttctccttttacataaaccggtcggcatgacttctcacgactgtgtaatgaaaataagaaaactgttaaaaacaaagaaagtcgggcatacgggaacccttgatccggaagtgtcaggcgtactgccgatctgtgtcggacgggctacaaagatcgttgagtacgtcaccgacaagtcaaaaacgtacgatgctgagatcactctcggtttctccacatcgaccgaagatcagacgggagaaacggtcagcgtaaagcctgtcagggagccgctggaagaagcggatatcaaagccgttttagacgaattgaagggaccgcaggagcaagtgccgccgatgtattccgcggtaaaggtcaacgggaaaaagctctatgaatacgccagagcgggtattgaagtggagcggccgaagcggaatatcacgattgaagatatcgcgctcacttcccctgtcacttataacgaagacacagcatcattccgctttacagtcacgtgctcaaaaggcacttacgtcagaacgttggcggtgacaatcggtgaaaaactcggctatcccgcgcatatgtcgcatctcatccgcactgcttccggcgatttcagccttgatgagtgtttcacgtttgaggaacttgaacagcaggtttcggacggaacggttgcagagcatgccgtgccgatcgatagagcgctcaatcatttgccgaaatgggtcataagtgatacattagctaagaaagctgaaaacgggtcagtgtttgacatcccggcggaattttctgcaatgacagctgacgcccgtatagcggtctgtactgaagacggagaatgtgtggccatttatatgccgcatccttcaaaaaaaggactgctgaaaccggctaaagtgctcatgcaaaaaagcgaacaataagaaaaaaggtgaccgttctgtgaagacgatacatatttctcatccgcatcatttacaaaaagaagagcagccggcgtctgtcatggcgctcggctactttgacggcgttcatttgggacaccggaaagtaatcggaacagccagacaaattgccgaagaaaaaggcctgtcgctggccgttatgacgtttcatccccacccttcccatgtgttgggcagggacaaagagccaaaggatctgattacgccgcttgaagataaaatcagccagatcggacgtttaggcgctgatgtgctgtatgtcgtaaagtttgatgaagcgtttgcgtctctgtctccaaaacagtttgccgaggagtatattttagggttgaacgcgcggcacgctgtgggaggcttcgattttacgtacggaaaatacggaaaaggcacgatggagacgctgccggacgatttaaacggcaaggccggatgcacgactgtcgagaaacagaccgagcaggacagaaagatcagctccacttatatccggtcagcgctccaggatggtgacgttgaacttgcgcacactcttctcggccagccgtattttctccggggcactgtgattcacggagacaagagaggccgcaccatcggttttccgaccgcgaatgtcggcctgcacaacagctatatcgtgccgccgacaggcgtgtatgcagtgaaagccgaaataaaaggcgaggtgtatgaaggcgtctgcaacatcggctacaaaccgaccttttatgaaaagcgtcccgatcagccgtcaattgaagttcatttgtttaattttcaacaggatgtatacggagaagacgttaaaatcgagtggtacaaacgaatccgaagcgaacggaagtttaacggcatcgatgaactgacggctcagatcgggaaagacaaacaagaagcgatccgttttttcagcaaataacggaaaaaacatcaaaagtacacaaattttattctaaaagatttgcatatgggcgcgatttttagtatcatatgtttcgtagtcttaaaaccattgcttggcaatccgaagtcaccgacggttgctaggtaactggggctaattatgatatggaggtgaaacaggatggcaattactcaagagcgtaaaaatcaactcatcagcgagttcaaaacacacgaatctgatactggttctccagaagttcagatcgctatcctaacagactcaattaacaacttgaacgagcatttgcgtactcacaagaaagatcaccactcacgtcgcggtcttcttaaaatggtaggtaaacgtcgtaatcttcttacgtatctgcgtaataaagacgtaactcgttaccgtgagttaattaacaaactaggcttacgtcgataatcgtaaaaagcgggaggattcccgcttttttatcgtattaaagcgaaaaaaataataataaaaaaacaatgaaatccttttacatactactttgacattgatatgttcaattcatttcgttcataataggagtaattgattatttcacacattaagagaggagctcgtaatcgaatgggacaagagaaacatgtctttaccatagattgggccggcagacagcttacagtagaagccggccagcttgccaaacaggcaaacggcgctgtcatggtccgctacggcgatactgcagtgctcagcacagcaaccgcatcaaaagaaccgaaaccgctagattttttcccgcttaccgttaactatgaagaaagattatacgcagtaggtaaaattccgggcggttttattaaaagagaaggccgtccaagtgaaaaggccgttttagccagccgtctgatcgaccgtccgatccgcccgcttttcgcagacggattccgtaacgaagtacaggtcatcagcattgtcatgagtgttgatcaggactgctcatctgaaatggctgcaatgttcggttcatcactcgctctttgcgtttccgatatcccgtttgaaggcccgatcgcgggtgtgacggtaggccgcattgacgggaaattcgtcatcaatccgacggttgaccagcttgaaaaaagtgatatcaacctcatcgttgcaggcacaaaagatgccatcaacatggtggaagccggagcggatgaagttcctgaagaaatcatgcttgaggcgattatgttcggtcacgaagaaatcaagcgcctgatcgcattccaagaagaaatcgtcgcagcagtcggcaaagagaaaacagagatcgaactgtatgaaattgacgaagagctcagcgcaaaagtaaaaagccttgcggagccggatcttctcagcgccattcaggttcacgaaaaacatgctcgcgaagacgcgatcaatgaagtgaaaaatgcagttgtcgcgaaattcgaagaagaagagcatgatgaagatacaattaaaaaagtgaaacagacactgtctaaactcgtgaaaaacgaagtgcgccgtttgatcacagaagaaaaagtccgtccggacggccgcggcgttgatcaaatccgcccgctttcttcagaagtcggtcttctgccgagaacgcacggatccgggctgtttacgagaggacagacgcaggcgctcagcgtttgtacattaggcgcccttggagacgttcagattcttgacggtttaggcgtggaagagtcaaaacgctttatgcatcattataacttcccgcagttcagcgtaggggagacaggcccgatgcgcggaccgggacgccgtgagatcggtcacggtgctcttggagagcgtgcgcttgagccggtcattccgaatgaaaaagacttcccgtatacggtccgcctcgtatctgaagtgcttgaatcaaacggttccacttcacaggccagcatctgcgcaagtacgcttgccatgatggacgcaggtgttccgattaaagcccctgttgcaggtatcgcgatgggacttgtgaaatcaggcgagtactatacagtattgacggatattcaagggatggaagacgccctcggtgacatggactttaaagtagccggcacggaaaaaggcgtgacagcgctgcaaatggacattaaaattgaaggcctttcaagagaaattcttgaagaagcgcttcagcaggcgaaaaaaggaagaatggaaatcttggacagcatgctcagcacgcttggtgaatcaagaaaagaactttctcaatatgcgccgaaaattttaacgatgaccattaatccggataaaatccgtgacgttatcggaccgagcggtaaacaaatcaacaaaatcattgaagataccggtgttaaaattgacattgaacaagacggcaccatctttatttcttctactgatgaaagcagcaaccaaaaagcgaaaaaaatcatcgaagatcttgtcagagaagtcgaagtcggccagctttacctcggtaaagtgaaacggattgagaaatttggcgctttcgttgaaatcttcagcggaaaagacggtctcgttcacatctctgaactagcgctcgaacgggtcggcaaggttgaggatgttgtgaaaatcggtgacgaaatccttgtgaaggtaactgaaattgacaaacagggacgagtgaatctgtcgcgtaaagcagtgctgcgcgaagagaaagaaaaagaacaggaacaacaacaatcttaaatgaaaacctaacaaggagcctgggagacccggcttctttattttgagaaagacaacagacgggttctaccttgtcctcctcatacataatgtgtgatgagggggaaggacatgttgaaaaaattcgtgccgtttgccgtttttttatttcttttttttgtttcgtttgaaatgttaaaaaacccgtatacagttgattacatagacgcaatgaaaaaagacgcggtaactgtgtcatcatcaaaagatccgctctatgaagaattactgcaaaaagcgtcagagtatgaagtgaagccgcaagacgctcggattgataaaatatggaagagtataccgggatataacggtttaaaagtcaatgtggaaaaatcctataaacaaatgaaaaaggacggagaatttcacgaagacgaccttgtctatgagcaggtaaagccgaaagtccatcttgattctctcgcgcccgaacccatttataaaggaaatcccgacaaaccgatggtcgctttcctgataaatgtcgcctggggaaatgaatacgtggagcaaatgctgcctattctgaagcagcaccaggtcaaagcaactttctttcttgaagggaaatggctgaaaaacaatcaggaactggggaaaaaaatagcggcagacggacatgaaatcggaaatcattcatacaatcaccctgatatgagcaaactgacttcaggaagcatttccgaacagctcgacaaaaccaatgcacaaatcagcgagacgctcggcatgaagccgaaatggtttgcgccgccaagcggcagcttcagaaaagccgtggtcgaccttgcggcggaaaaaggaatgggcaccatcatgtggaccgttgacaccattgactggcaaaaaccgtctcccgctgttttacaaacaagggtgctgagcaaaatacataacggagccatgattttaatgcatccgactgatccgactgcgaaaagcctggatacactgattgcaaaaatcaaagaaaaaggctacgcgctcggctcagtgtctgacttaatggatgaaaacaggctgatgaagtagcaggcagctgcctgtctttgaataggaggaacagacttgataaaacgctatacatgccaaaacggtgtaagagttgtgcttgaaaataatccaacggtgcggtctgtggcaatcggcgtatggatcgggacgggatcacgtcatgaaacgccggagacaaacggtatttcgcactttcttgagcatatgttttttaaaggaacaaataccaggtccgcacgtgaaatcgcagaatccttcgatcggataggcggccaagtgaatgccttcacttcaaaagaatatacgtgctattacgccaaagtgctggatgagcatgcaaactacgcacttgatgtgctggctgatatgttctttcattctgcttttgacgaagatgagctcaaaaaagaaaagaacgtcgtatatgaagaaatcaaaatgtatgaagacgcaccggatgacattgtccacgatctgctgagcaaagcgacatacggcaatcattcgctcggatacccgattctcgggacggaggaaacgctttcgtcgtttaacggcgattctctcagacagcatatggatgacttttacacgccggaccgcgtcgtcatttctgtcgccggaaatgtaacggaacaattcattaaagacgtggagaaatggttcggtacatacgaagcgaagggcaaagcaagcggcatcagcgagcctgagtttcattatgaaaagctgacgagaaaaaaagacaccgaacaggcgcatctctgtctcggtttcaaaggcctgaaagtcggagatccggacatttacgatttgatcgtcttaaacaacgtgcttggcggaagcatgagcagccgtcttttccaggatgtgcgcgaagataaaggactggcctattctgtatacagctatcacagttcctatgaagacagcggtatgctgacgatttacggaggcaccggcgcgaatcagctcggacttctgtctgaaaccattcaggaaacgttatcggttctaaaacgtgacggtatcaccccgaaagagctggaaaacagcaaagagcaaatgaaggggagcttaatgctcagcttagaaagcacaaacagcaaaatgagccggaacgggaaaaatgaactcctgctcggaaagcataagaccatggatgaaattatcgctgaattaaatgcggtcagcctggaaagcgtcaacggcctcagccgccgcttatttacggatgattacgcactatcgctcatcagcccgaccggcaatataccggcctcgtcttaagctgcaaagcagtctgcctctgtacggggcaggcatttttttttgctccgggtcatatagtacaaggggtggctatcatgaggctcagtgaactgtcaggtaaagaaattgtggatattaaacgggcagagcggctcggcgtgctcggccagaccgatttggaaattaatgaacaggacggacaaattaccgcgctgttgataccgacggtaaaatggttcggactgcgaaaacaaggccacgacatccgcgtcccctggaaccatatccaaaaaatcgggtcagacatgatcattttagacgttccgggggagatcacgcctcccgaagagtagatcttattcattttttgcaagcaccggctcatacagccggtgctttttttatgaaaaagacgctgtacattcaccgccctttctctttgcacatacgatgaagaggaggatgacacttaaaggatccagtaactgtaaagaaggtgaacgtttcagatgttaaccggattaacaattgcgatcattggcggtgacgcaagacagcttgagattataagaaagctgacagaacagcatgccgatatttatcttgcagggtttgaccaattggatgacggttttacaggaaccgtcaaatgcaaaattgatgagattccctttcaaaaaatagacagtatcatcctgcctgtatcggcaacgaccggagaaggcgttgtttccacggttttttcaaatgaagaagtggtattaaagcagagctatcttgagcggacaccggagcattgcgtcatttattcaggcatctccaacgcgtatcttgaggggatcgccagcgaagccggccgtaagcttgtgaaattatttgagcgggacgacatcgcgatattcaactcgattcccactgttgaaggaacaatcatgatggcgattcagcatacggattataccattcacggatcaaatgtcgccgttcttggcatggggcgcaccggtatgacgatcgcccggacgtttgcagcgttaggggcgaaagtaaaagtgggcgcgcggagttcggctcatttagcccgtatatcggaaatggggctttctccttttcaacttgaagagcttactgatcatgtaaatgatattgatatctgcattaacaccgtaccgagcttgattctgaatcaaagcgttttatcgcgcatgacgcccaagaccttgattttggatttagcatcccgtccgggcggaacggatttcaaatatgctgaaaaacaaggcattaaagcgctgcttgctccgggtcttccgggaattgtggccccgaaaacagccggacagattattgcgaacgtattgagcaagcttttggcagacttaaagaaagaggggaaataaccatgtctctgaaagggaaaagaatcggattcggattaaccggctcgcattgcacatatgaggaagtgtttccgcaaatagaggcgcttatcagtcaaggagctgaagtccggccggtcgtgacatcaaccgttcaatcgaccgatacccgctttggggaggggggagattgggtcagaaaaattgaagaaacaacaggctttgaggcgattgattccatcgtaaaagcggagccactcgggccgaaacttccgctcgactgcatggtcatcgcccctttaaccggaaattcaatgagcaaactcgcaaatgcgatgaccgacagccccgtccttatggctgcgaaagccacgatccgcaacggccgcccggtcgtgctcggaatttcgacaaatgacggactcggtttaaacggaacgaatttaatgaggctgatgtccgcaaaaaacatatatttcatcccgttcggccaggatgaccacgtgaaaaaaccgacatcgctcgtcgccagaatggatctccttccgattacggtagaaaaagctcttttgcaccagcaggttcagccggtgctcgtacaccatcatgaataaaaaatcatgatgacagaaaatcattccggaataaaaaaattcggtcaatccgtgactattctatggtaaaataaaacgtaaaatgcaaagtcaattcaacaaatgatgcttaattggcggaaggagttttacagatgggaagaggattacacgtagcagttgtcggagcgacgggagccgtaggacagcaaatgctgaaaacactggaagacagaaactttgaaatcgaaacactcacactactatcctcaaagcgttctgctggtacgaaagtaacgtttaaaggcgaagaatatacagtgcaggaagctgttcctgaaagcttcgaaggcgttcatatcgcgttattcagcgccggcggaagcgtatcacaaagcttggcgcctgaggctgtaaaacggggagccatcgtgattgacaatacgagcgcattccgtatggacgaaaatacaccgctcgtggtgcctgaggtgaacgaaggtgatctgcacaaacataacggcattatcgccaaccctaactgttcaacgattcagatggtggctgcgcttgaaccgatccgcaaagcgtacggtttgaaaaaagtcattgtatctacttaccaagctgtgtccggagccggcaatgaagcggcgaaagaattgtacagccagacaaaggcgattttaaacaatgaacccgcagaaccgtccattatgccggttaaaggcgacaaaaagcattatcaaatcgcatttaacgccattccgcaaattgataaattccaagacaacggctatacgtttgaggaaatgaaaatgattaatgaaacgaaaaaaatcatgcatatgccgaagctggaagtggctgcgacatgtgtaagactgccgattgaaacagggcattcagaatctgtttacattgagcttgaccgtgatgacgcaaccgttgaagatattaaacagcttttaaaagaagctccgggtgttacgcttcaggatgatccggcggagcagctttacccgatgcctgctgattgcgtcggcaaacgcgatgtatttgtaggaagaattcggaaagatttggacagagcaaacggttttcatttgtgggttgtttctgataacctgttaaaaggcgccgcttggaactcagttcaaatcgcggaaagcctgcaaaaactgaacctcgtataaaacaaacgtattttctataggcgaacagaagagagtaaggctctgcctgctctcttctgttacgtcagactaatttggagtgaaaatagtgaagatcattgttcaaaaattcggcggaacatccgtaaaagatgacaaaggccgcaagcttgcgctagcacacataaaagatgccataagtgaaggttataaggttgtcgttgttgtatcggcgatgggaagaaaaggagacccgtacgcgacagattctttaatcgggctcctttacggcagccagtccgacatttctccgagagagcaggatatgcttctgtcttgcggagaaacgatttcgtccgttgttttttccagcatgctgaaggaaaacggcataaaagccgcagctttaacaggagctcaggccggctttttaaccaatgcccagcatactgacgccaaaattatagaaatgaaaacagagcggcttttcgctgcactcgccagccatgatgccgtcgttgtcgcaggctttcagggagcgactgaaaaaggcgacacgacgacgatcggcagaggtggaagcgatacatcagcggcggcgctcggcgcggcggttgatgctgagtttatcgacatttttacggacgtggaaggtgttatgacagccgatccgagaatcgtggaaaatgctaagccgcttccgaatgtcacatatacggaaatctgcaaccttgcttatcaaggcgcgaaagtcattcatccgcgcgcggtggaaatcgccatgcaggcaaaggtgccgatccgcgtgcgctccacttattcaaaagacaaaggcactttggtgacgtcccatcattcgtctaacatcggcagcgatgtattcgaacggctgattacggggatcgcccatgtgaaagacgtgacgcaatttaaggttcccgccaaaatggggcaatacaacgttcagactgaagtctttaaagcaatggcaaatgccggaatcagtgtagatttctttaacattacgccgagtgaaatcgtatataccgtagccggcagtaaaacggaagccgcgcgcagcattttggctgaattaggatatgagccgacagtgacggaaagctgtgcgaaagtgtcagcggtcggcgccggaataatgggtgttccgggtgtcacgtcaaaaatcgtctccgcactttctgataaaggcattccgattctgcaatctgccgacagccatacgacgatctgggtgctcgttcatgaaaaagatatggtaacggccgtaaatgcgctgcatgaagtgtttgaactttcaaagtaaatgtgattgaatcatgatgaggtgaaaaaaatgaatgtcggaaatatatctacagcgatgattaccccctttgacagtaaagggaatgtagactttcaaaaactgtctacattaatcgactatttgttgaaaaacggcacggattctttagtcgtcgcaggcacgaccggcgaatccccgacactttcaacggaagaaaaaattgcactctttgaatttacagtcaaagaagtgaacggacgcgtgcctgttattgcgggtacgggaagcaacaatacgaaagattccattaaactgacaaaaaaagctgaagaagccggcgtcgattgcgttatgcttgtcacgccgtattataataagccttcccaagaggggatgtaccgtcattttaaagccatagctgaagaaacgtctcttcctgtgatgctttacaacgtgccgggcagaacggtcgcttcgcttgcgccggaaacggccatcagacttgcggagattccgaatatctctgcgattaaagaagcgagcggcgatcttgatgccattacgaaaatcattgccgaaacgccggaagatttttacgtctattcaggtgatgacgggttaacgcttcctattcttgcagtcggcggaagaggagtcgtgtcagtggccagccatattgtgggttctgacatgcagcagatgattaaaaactatacgaacgggcagacggcaaccgcggcactgattcatcagaagcttctgccgatcatgaaggagctctttaaagcgcctaatccggctccggtcaaaacggcgctgcagctgaaaggccttgatgtcggatctgtgcgtcttcctcttatcccgctgaatgaagatgaacgtctgagcctgagcagcgtcatcagcgaactgtaagaaaaaatttatacagttgaaatacgcggtcattctcatttttatcgtgagtttgaccgttttgtatacatattggttttccctaaaccttccgcttcttcttgttttctaaaattgatatcagttataataggaacaagtgatgatggacgggtatgagactaggaggatacagattttgaaaaagaaaaatacagaaaacgtcagaattatcgcccttggcggcgtcggagaaattgggaagaacctatatgtcattgaaattgactcagacatatttgtagtggatgcggggctgatgcaccctgaaaatgaaatgctcggtattgatgtcgtcattccggatatttcctacttagtagaacgggctgaccgcgtgaaggccatctttctgacacacgggcacgatgaaaacatcgggggcgtcttttatttattgaacaagctgtcggtgccggtatacggaacgaagcttacgcttgcattactgagagaaaaactcaagcagtacgggcataatcgaaaagctgatttacgtgaagttcactctaaatcagtcattacatttgaatcaacgaaagtatcgttctttaaaacgattcacagtattccggattcagtgggagtcagcttcaaaacatcacttggctctattgtatgcacgggagacttcaaatttgaccagacgcctgcttatcatcaatcatgtgatattggcgaaattgccaaaatcggaaacagcggcgtgctcgccctgctttctgacagcgccaatgcggagcgcccggggtatactccgtcagaagcatatgtaagcggtgaaatttccgatgcgatgaacaattcagaaaaccgtgtcatcattgctgtattcgcgtctaatatcaaccggattcagcaagtgatacaggctgccgtccagaacggccgcaaacttgcaatcgccggaaaaaatctgcaaaacgtgcttcagcttggacgcaagctcggctatattgaagccgaagatgaaatgtttattcctgtgcaggatgtgaaaaaatatccgaagcgggacgtggcaattgttacagccggaagccatggtgagccgctggccgctcttacgcgaatggccaagcaggcgcacaagcagcttaacattgaagaaggagacaccgttgtcattgcatcaacaccgattccggggcatgaattgatatattccaaaaccgtcaacctgcttgcccgcgccggcgctcaagtcattttcgcccaaaaacgagtgcatgtgtccggtcacggttcgcaggaagaattgaaactcatgcttaatttgctgaaaccgaaatatttaattccggttaacggtgaattcagaatgcaaaaagcgcattccaaaatcgcagaagagatcggcatgaaacgcagcgacattttcttgattgaaaaaggtgatgtcgttgaattccgcggccagaatgtgaaaatcggggataaagtcacatacggaaacgttctgattgacggcctcggagtcggcgacatcggcaacatcgtgctgagagaccgccgcttattgtcacaagacggcattctcatcgtcgtgatttcactcgataagcagaagaagaaccttgtttcaggccctgagatcattacgcgcggtttcgtgtatgtcagagaatcagaggggttaattgtacaagctactgagctcgtccgctctatcgtgactgaagcgacggaaacatctgccgtagaatggtccacgctgaaacaagcaatgcgtgatgcgctgaatcaattcctttatgaaaaaacaaaacgcaagccgatgatcattccgatcattatggaagtataatgtatacaaagccggagcgcatgatgctccggctttgtttttgttcatgtcccggatggaaatcatcatctttgttcataatacaaagagacattcggaaagggtgaaagataaaatggatcatcgtatggaaaacaccgaagaacagcagcccgaaaaatcagatgcgaaagacagcattatgagcaaaattcagcagctgggagagacatctctgccgcaaatgtcccaagataccaatattcactgcctgacgatcatcggccaaattgaggggcacgtccagctcccgccgcaaaataaaacaaccaaatatgaacatgtcattccgcaaatcgtcgccattgagcaaaatccgaaaatcgaaggacttctgatcatcttaaacaccgtcggaggcgatgtggaagcggggcttgcgattgcggaaatgctcgcatccttatcaaaaccgaccgtctcaatcgtactcggcgggggccactccataggtgtgccgatcgccgtgtcatgtgatcatagttttatcgcggagacagcgacaatgaccattcaccccgttcggcttacaggtctggttatcggcgttccgcaaacgtttgaatacctggataaaatgcaggagcgggtcgtcaactttgtgacccatcattcaaatatttccgaagaaaaattcaaagagctgatgttttcaaaaggaaacttaaccagggacatcggaacgaacgtagtcggcaaagatgcggctgattacggattaattgatgccgtgggcggcgtcggacaggcgataaaaaagctgaatcagctgattgaggaacgaaagggcgaggaaggaaggatgattcaatgatcctttataccgtcatgccacaagaagtcgtttacggtcaggatatagagcaaagcgtgcatgaacaggtagattacgccggcgtgccgctgctggttgagatgaagggaaatgaagctgaagtcgtacagattttaagtacgaacccgatggattttctgaatccggacatcgctccgggacaaaaaatcaagctgaaaatctaaccggcattcagtccgtttctcgggggcaaaatatgctataataggggaatcctacagaaaaatgcagccggcaaaaggctgcttttcttcatgatgtatgattttacattttttaacgcagtaaggtgatgagtgtggcaaagaaaaaacggaaatctaaaaagaaacaagagagtaagctcaatctaaaatacgaactaagcggactgctctgtgttgcaatctcgattattgctgttttgcagctcggcgttgtgggacagacatttgtgtacttgttccgtttttttgccggagagtggtttattttatgcttaattgcgctcttccttctcggaatttcgctgttttggaaaaagaagagtccaagccttttaacgaggagaaaggcagggttgtactgtattatcgccagtattttgctgctgtctcacgtgcagctctttaaaaatctgtctcatcacgggtcgattcggtcggcaagtgtcatcggcaacacgtgggagctgtttatgattgacatgaaacagcaggctgcttcccctgatttgggcggcggcatgatcggcgcggtgctgtttgcagcttcccactttttatttgcatcaacgggttcacagatcatggcgatcgtgctgatcttaatggggctgattcttgtaacggggcgttcactgcaggaaacgctcaaaaagtggacgagccccgtcggccggtttatccgcggtcaatggcaggcatttcttgaggatatgaaaacggtcagaacgaatatgtcttcgccgaaaacaaaaaccaaatcgggcaaaaaacaaaaacgggttcagaagaaaaaagaaatgcctgagcccgaagaagaggatgaggaaatcatttcgccgatcatccattcagagccgattatttcaagcttttcagaccgtcaggaagaacgcgtcgaaccgctgattccggaaaaaacgcaggagacggcgcaaacggcaaaagatgagccttccggcggcgctcaagacagtgacgaaacggctgcggctccgccgatgacgtttacagagcttgaaaataaagattatcaaatgccttcattggacatcctggctgacccgaaacataccggccagcagaccgataagaaaaacatttacgagaatgcaagaaaactcgaacggacctttcaaagcttcggggtaaaggcgaaagtgacccaagttcatctcggcccggcggtcacaaaatatgaggtgtatccggacgtcggggtcaaagtcagtaaaatcgtgaatctgagcgatgacctcgcgctcgcgcttgccgccaaggatatccggatagaagcgccgattccgggcaaatcagcaatcggcatcgaggtgcccaatgctgaagttgcgatggtttcgttaaaagaagtgcttgaatccaagctcaatgacaagccggacgcgaagcttctgatcggcttgggacgaaatatttccggggaagccgtgcttgccgaactgaacaaaatgccccacctgctcgtagcgggggcaacgggaagcggaaaaagcgtctgtgtcaacggtattattacgagcattctgatgagggccaaaccgcatgaagtgaagatgatgatgattgacccgaaaatggttgagctgaatgtgtataacggcattcctcatctgcttgcgccggtcgtgacagatccgaaaaaggcctcgcaggctttgaaaaaggtcgtcaatgagatggagcgccgctatgagctgttctcccatacgggtacgagaaatatagaaggctataacgaccatattaagcggtcaaatgccgaagaagaagtcaagcagcctgagctgccgtacatcgtcgtcattgttgacgagcttgccgatctgatgatggtcgcttcttccgacgtggaagattcaattacgagactttcacagatggcgcgggcggcgggaattcatttgattatcgcgacacagcggccttcagtcgatgtcattaccggtgttattaaagccaacattccgtcaagaattgccttcagcgtctcatctcagaccgattcacggaccattttagacatgggcggcgctgaaaagcttctggggcgcggagacatgctgtttctgcctgtaggcgcgaataagcctgtccgggtccagggagcatttttatcggatgaagaggttgagcatgtcgtcgatcatgtgattacgcagcaaaaagcgcagtatcaagaagagatgattccggaagaagtgtcggaaacacacagtgaagtaacggatgatctctatgacgaagcggtcgatttgattatcggcatgcagacggcatcagtctccatgcttcaaaggcggttcagaatcggatatacgagagctgcccgtctgattgacgcaatggaggaacggggcgtcgtcgggccgtatgaaggaagcaaaccgagggaagtactattatctaaggaacaatatgatgagctctcttcttaaaaaggagagagttttcactgaaaatgatatcaccaaaatcattcctatttatttttttattaaaacatgatatagttgtcccaattgttcaataatttatgaaagtggtttacggaggggaaacatgtctacaaaagctgacaatcgtcacttgtacctaaaagtgattgagcgaatcaaagaggatatacaaaacggaatttacaccgaaaaggaaaagcttccttctgaatttgagctttcaaaatctatgggtgtcagccgggcaactctgcgtgaagctttgcgtatccttgaagaggagcatgtgattatcagaaggcacggtgtgggcactttcgtccatacaaaaccgctgtttctttcaggtattgaacagctcaacagcgtgacgaaaatgattcagcaggcgaacatggtgccgggtacgatttttttgtcgtctcaggtcatcacgccgtctgaggaagatatcgctagattccggcttgagcctgagcaggagcttttttatttggaacgcgtgagaacggcaagcggcactccggtcgtttactgtttagatacgattccgatgcacattctgccgaattctttctgtcatgaacaggaatctatttttgatcttttggaaaaaaactccgggtctgtgatcagctatgccgttgccgatatcgaaccgatcggatatcacgatacgatttcaccggttttggagtgcgagccggagacggcgcttttattgctgaagcaaacccactataatcagaatgatgaacctgtgctgtattcattaaattatttccgggctgataagttcagttttcatgttgtaagaaaacgtttttaagacagacgcgtcatgtgtctgtttttttatttgccgcttcaatacatactttgttttccgcaaggcacaataaaacaggaaacaaccaagtatagtgaatgggtgaataagttgagtaagaagaaaaatggaacaaaaaatatcattgctctggcttctgtaccgctcgtgatgacactcgggaattccatgctgattcctgtgcttccgatgattgaaaagaagctgtccatatcgtcttttcaagtatcgttaattataacggtctattcgattgtggcgattatttgtattccgattgccggatatttgtccgataaattcggaagaaaaaaggttcttctgccttgtcttctcatagccggtgcgggcggagcgcttgccgcgatagcttccaccgcgttcaagcatccttatcccattatcttggcggggcgggtgctgcagggaatcggttcggcaggggcggctcctgtagtgatgccgtttatcggtgatttattcaaaggggatgatgagcggattaccgcggggctcggcgacattgagacgtcaaacacggccgggaaagtattaagcccgattctcgggtcgctcttggctgcatggttttggtttatgccgttttggttcattccgtttttttcgcttatcagtttttttctcgtattgtttttggtggcaaagccggagaaacaaaaagaagccccttctatttccgaatttgtaaaaaatgtcggccgcatatttaagcgtgacggacgctggctctttacggtatttatcatcggctgcgtgattatgtttttgctgttcggggttcttttttatttatcagactcactggagaagaaatacggaattgacggtgtggctaaaggagcgcttttggcaatcccgcttttatttctatccgtcagttcatatatatcaggcagaaaaatcgggaaagaccaaggcaaaatgaagttctgcatcgttttcggaatgagtgccgtgacactgtcgtttatcggcctatggtggaatcacagtttttatttattatttatctttttgtgtgtcagcggtatcggtatcggaatagcattaccggcattagacgctgtcatcacagaaggcgtagacaacgaggaatcgggaaccatcacctcattttataacagcatgcggtttatcggagtagctgcgggaccgccgatctttgctgccctgatgtcaaatgcaggctggctgatttttattttatccgctttttgcggcattgtgtctgtatttttagcgctgttaaatatctcatcacaagcaaaagaaaaaaaggaatcattaaagacggtgtaatctgcactgtctttttttattttattttgaagattgacatgatatcgtcaagtcgttatcctttttaatagttaaacattttaactattggaaggagggggaaaagatgcatgaagaaaaagtaaagcagctgattcagcgttattccgatgtatacctgcacgtcttaaaaaaaattgacagcattatcgctgaaaaagtgaacaaagagctgacattggatcaatattacatactccgctatattatgctcaatccggattgcaaatcaattgaactggccgcggtgtgccacgtcaacaaaagcgccattacatcgatgacgaaccgcctgtatgaaaaaggctacatcaatagagaacgcagccaaagcgaccgccggagcatacttttaaatgtcacggaaaaggggacggaagtatttcaccgtgtggagcggcggattgaggaactcgtccgttcatatattatgtattttgatgaagacgaggcggagatgttcgttaatacatatgaaaaattatatcgattgatgatgacagaggaggatcagcagacataatgaaaaacattatccgagcccgctggatcatcgccgcggtatggatcgccgcaacggtgatatttatgcttacagcgcctgatatggctgaattgacacgggagaaagggcagatttccgtaccggacggatattcctcttcttatgcccatgaattgcttgatgaaatgtctgattcagatgcaccgtcttcttctgccgtcatcgtatttcacgaaaaaggcttaatgacagacaaaaaagatcgtctggaagaagccgtcagcactttgtctgaacagaaaaaagcgcttcagattaaaacggtgacttcatacttcggggagaaaaatgacgacatcaaaaaacagctgctgtcaaaagacagacaaacgatgctcgttcagctgcagcttgatacatccaaaaacgatatcctcgaaatcaaaaataaaattgataaagagctgaaaccgtacggcgtatcatacggcattacaggccagtcgctgatcgatgaagatgtgttaaaaagctcacaggacggattgaaaaagactgaatatataacggtcgcttttatcctgatcgtgctgatccttgtattccggtcagtggtcgctccgtttgtgccgcttttatctgtattgatatcttatttagtcagccagtcgattgtcgcatttttagtcgaccagctgaattttccgctctcaacttttacgcagattttcatggttgcgattatgttcggaatcggcacagactactgcattctgcttctcagcagatttaaagaagaactgtcgcatggcgctgatataagagaggcgatcgtcgtcacctacaaaacggccggaaagacggttttgtacagcggcggtgcggtgctgatcggatttgcctgcatcgggtttgcgacatttaagctgtatcagtcggcagccgccgttgcagtcggtgtcgcggtgctgctgcttgcgctcatgacgatcgtgccgttttttatggctgttttaggaaaaagactgttttggcccgttaagggtgatatttcccatcctcaaagtaaagcatgggaaacggcagggcggttttcatttaaaaggccgctcatcagtcttgcaatcgttgcggtattcaccgtcccgccgatccttctttacaaaggatcgctatcttacaacagccttgacgaaatcggggataaatatgaatccgtccgcgcgtttaatacgatttcagacgcattcggcccgggggagcttcttccggccacagtcgtcatcaaaaatgatgagcctctaaataccgaaaaacacctgattgatatcgaaaaaatcagcagagaacttgaaaaaacagagggtgtaaaaacggtcagaagcgccacgcgccctgccggaaacggattgaatcaattatttgtcacaaatcaggcaaagcagcttcaagaagggcttgataaaggcaatacaggacttgaaaaaatcacggacggattagggcatgccgcaaagtcgttagctgattcacagccgcagatcgaagagtcggggaaaagcgtcaatcagcttattaacggaacattgtctctgaaatccgggctttctgatataggcgaaaacctgaataaactgcaggcaggcgtgaatgagaataaagccggcgtcgcccagatgagaaagcagattgaagagcaaaaacaaatgctgacttcacagctcaaacaaaacagcggtctcgcttcagaaacgcaaaacgctttaaaattggtaaaaaccgtcctgccgatgaaagatgaaaccagcagacagcttgccgatttgaacaagcagcttgcccggctgccgtttgcaaaattggaagcgtcaataccgtcagtcaaaaccgatccctcttacaaagaaatcaaatcggcctttacgggtgtacagtcagccgtttccaaggcaaacgcggatgcagaagcgttttctaaacaggtcgacagtcaaaaggatcatctgcagcaagcggaaaaacaatttgcccggctggcagccgctcaaaaaaagatcgacactcaaattaacgcaatgatcaccggtctgaccagtattgaaaacggtctgcagcaagtgtcagacggacagggggctcttgcaggacaaatgccgcgccttgaatcggcggcaggacagctcgcggagggccagaaaaaaatgaagagcggtctcggtgatttttcttcccggctcagcgatctttcttcaggccttaacgatagtgtaaaagggcttaagaaagtatcaagcggcatgatgggggcgaatgattacctgggtgagcttcacaaggcctcagataaagaaatgacaggctggtttgtgccgaaagacgcgttgacaaacagtgatttcacaagcgtgtttaatacgtacatgtcagatgacagaaaaacgacagaattgaccgtcgttcttgataacaatccttactcaaatacggccattcaagatattcaagcgatcaaagcgagcgtaaaaagagccattccgaacacggatctgaagaatgcctctttcggcgtttcgggagtctccagcatgaatgccgatctgaaagaagtatcggattcagacttcaaacggacggcaatgtttatgctggcgggaatttttctgattctcatcataatgctgcgctctcttattatgcctgtttatttagtggcgtcgctcgtactgacgtatttcgcatccatcggcgtgacggaatacatctttacacacttcttcgggtatccgggcgtaaactgggccgtgccgttcttcggctttgtcattttgatggctcttggtgtggattattccatctttttaatggaccgctttaatgagctgaaaaaagaaggaacggaacccgcaatgatcagcagtatgaaaaatatgggttccgtcatcatttctgcggcgattattttagcgggaacctttgcggccatgctgccgtcaggcgttctttccttattacagattgcaaccgtggtattaacaggccttctcatgtacgcaattgtcgtccttccgttttttgtgccggtcatggtgaaaatattcggaagagccaactggtggcctttcaatttgaaaaaataacgttcaatgcctctgcctgttttcgggcagaggttttttgtttccttataaatcctccagttgatataattacatctgcgcactcttttttgcgaatcctgaaatttggccataatacatactattaaagaatgaacgaaggaggtttcacatgacttacgtaaatgaaatgaagtcaaagcacggcgggatcaccgcccacatcgtaaagactgagaaatttaaaaccgtttcgctgacgtttaaaatgctggctcctttaacgaaagagctcgtaacaaaaagggcgctgtttccgcatgtgcttctgcgcggaacagaaagccgcccgaaaaccgctgatctgcgttcttattttgatgagctgtacggcacatccgtttcagctgatctgacaaaaaagggagaacgtcatgtcattacgttcagacttgagattcctaacgaaaagtatctgaaggaccgcacaccgttattggaaaaaggccttcagcttttatcagagcttgtcttttcgcccgctttggaaaacggcgccttcctgcccctttatgtcacgcaggaaaaacggacgctgaaacagcggattcaagccgtatatgatgataagatgagatattctaatctgcgtctcgttcaggaaatgtgcaaaagcgaaccgtatgcccttcacgtcaacggcgagttcgatgatgtcgaacacattacaccgcaagagttgtatgaagcctatcaaaaagccatacgcgaagatcagctggacctgtacgtcatcggcgatgttgattcagatcaggtgaaaacggccgttgatacgtattttaaaacggaagaacgggagctgcagccttttgaaagaagcaagacgaatgaacagcccgatccgaaggaagtcattgatgaagaggacgtcaagcagggcaagctgaatatcggattccggaccaatacgacatatacagatccggattatccggcattgcaggtgtttaacgggctgttcgggggtttctctcattcaaagctgtttataaatgtccgtgaaaaagcaagcctcgcctattatgcagcctcaagggtggaaagcttcaaagggcttttgatggtcatgtcgggcattgaggtgaaaaattataagcaggccgtcaccattatcgaagaacaatttcaggctatgcaaaacggtgacttttcagaggacgatatcgcccaaacgaaagccgttattaaaaaccaagtgttagaaacgattgatacggcatacggcttagcggaatttctgtatcagcaggcttcagcccaagtggaaataccgatcgaaactttcctcgacaatatcgagaaagtgacaaaagaggacattatcaatgtcggaaagaacattaagctggatacgacttatttcttaaaagggacggggggagcatcttgactaaaccgataaatttcgaacagcttcaggaaacgctgtatcatgaaaaaatggcaaacggccttgatgtctatgtgctgccgaaacagggttttaataaaacatacgccgtgtttacgacaaagtacggttccattgacaatcaattcgttcctttaaataaggaagaaatggtacacgtgcctgacggaatcgcgcattttctggaacataaactgtttgaaaaagcggacggcgacgtgtttcaggacttcagtaagcagggggcgtcggcaaatgcctttacatcatttacacgaaccgcttatctgttctccagcacttctaatgtagagaaaaacctggaaacactcgttgattttgttcaggacccgtatttcacggaaaaatcagttgaaaaagaaaaaggcatcatcggccaggaaatcaatatgtatgatgataatccggattggcggctgtttttcggccttatcgaaaatatgtataaagaccaccccgtaaaaattgacattgccggaacggtggagagcatctctcatattacgaaagatctgctgtatgagtgctacgaaacgttttatcatccgagcaatatgctgctctttatcgtcggccccgcagatcctgaagcgatcatcagccaggtgcggaaaaaccaggagaaaaagccgtttacagaccagcctgaaatcaaacgtaaagaggttcaggagcaggaagcggttttccgccgggagcaggaattaaaaatgaacgtgcaaggctcaaaatgtcttgtcggtttaaaggcgaaagacccttataaaacggggcgggagctgttgaagcacgagctcagcatgaacctcatgcttgaatgtctcttcggaaaaagctcaccgcattacggcaacttgtacgataaaggctacattgatgaaaccttcagctttgattacacggctgaatacggattcggctttgcctctgtcggaggagatacaccagagccggataagctcgctgacgaattaaaacagatgctgcttgatgcagaatcagccgtaactgcggaaaaacttgaccttgcgagaaaaaagaagatcgggtcatttttaaaagcgctcaattcgcctgaatacatcgccaaccaattcacacgctacgcctttttagatatgagtctgtttgatgtcgtaaccgtactggagcagatcaccctggaagacgtaaagcgggtcattaaagaagaaatatcagaagacaggctgacagtctgcaaagtcgtgccaaaatcataacaaaacatccctcacgccctgagggatgtttttctggggaaagaaggagtattgattgatgaaacagacagcgctcgtaaccggagcaagcggcggaatcggacaaagtataagtgaagtcctcgcaaaaaacggatatgacgtccttttgcattatcattctaataaggaagccgcacacaggcttgcggaaaggctgagcgcatcattcggcgtaaaagcctccgctatccaggctgatctgtcctcaccggatggcgcggagacactcagccgttccgttaagcagcctgtggacgctctgatattaaacagcggcaaaagtcatttcggcctgattacggacgttacggatgacacggcgcgggagatggtgcagctgcatgtgacgagtccgtttcttttggcgcgtaatctggtgcccggcatgatccggaaaaaaagcgggggcattgtcgcgatcggttccgtctggggagaaacaggtgcatcgtgcgaggtattatacagcatggtcaaaggagcgcagcattcgttcgtcaaagcgcttgccaaagagctcgctccgagcggcgtccgcgtgaatgcggtctcgccgggtgccgttgatacaaatatgcttgatcagttcacgtctgatgaaaaagaagcgttggcagaggaaattcccgcgggccggctggcgaagccggaggaaatcgccgaagcggcggcctttttattatcggacaaggcttcctatattacggggcatatattatccgtaaacggcggctggcactgctgaaaaaaatgtgtgtatagtttgcatctgcacggacaaaataattttgtaacaacagatgaaatggaggaacccaacatgtcagtattagaaaactgggataattggaagaatttccttggcgacagattgaactatgcgcaggaaaaagggatgagtgatgaaacgatcactgacctcgcgacagaaatcggcggttaccttgcgaacgaagtcgactcgaaaaaccatcaggaaaaagtgcttgctgatctttggagcgttgcttctgaagatgaacagcgcgccatcgcaaatatgatggtgaagcttgttgaaaataacagcactcattaagaggggggatttctcctctctttttttatgttttcctctatagagcaacattcttctttctaattagagaaaaatgttttatgataaaggaaggtaaaaatttgccacaatggagggggtatatcatttggcaaagctcgaatggtattttgaatatgaaattcaagtgaaccgccccggcctgctcggggatatttcatctcttctcgggatgctgtcaattaatattgtcacaattaacggtgtcgacctttccagaaggggaatgctgctcagatgccggcatatagatcaaattaaacgattggaatcaattttaaaaacaatggagaccattaaagtaacgaagttgagagaaccgaggcttcgcgaccgtctcgcagtccgccacggaagatacattcagcgtgatgccgatgacaaaaaaaccttccgttttgaaagggacgagctcggtcttctggttgactttatggccgagctgtttaaaaaagaagggcacaaactgatcggaatccggggaatgccgagggtcggaaagacggagtccatcgttgcgtcaagcgtttgtgccagcaaaagatggcttttcgtatcatcaacgctgctaaaacaaacgatccggagccagctggttgccgatgaatacagcacggaaaacgtgtttatcctcgacggcatcgtttcgacaagacggggatctgagcgccatcttcagctcgtcagtgaaattatgcggcttccggcgacaaaggtcgtggagcaccccgatatttttgttcaaaattcggagtatacgctcgatgatttcgattatattatcgaactcagaaatgatcctgacgaagtcattacatatgaacatgcagaagaaccgcaaatgtttgaccagaccggtttttcaagctttgatttttaatattggaaggtgtttgttgtgacagaattagcaatccggcttaaagaagccagagaggaaaaagggatgtcattggatgaactccaggcggcgacgaaaattcagaaaagatacttaaccgctctggaagaaggcaattatgacgtcattcccggcaatttttatgtgcgggcgtttatcaagcagtacgctgaagctgtcgggcttgattcagatcagttattcgaagaatataaaaaagacatccctaacacgtaccatgacgatgtgtcggaaaaaatctccggtctcgccatgcaaagggagcttcctaagtccgcttcaaaggcggcggaatggcttccgaccgtccttgtcgtcatcggtgtcattatcgtcatcgcgatcatttatgcgattattcagttcggaatgagcaaatccgggcagacagacggagataaggccgtcacccaaagtgagagcaagtatgagattcctaaggattctgcgctgaaaaacgacggcaatacaaacgacgaagcgcaatctgacagcaaaaaagacacaaaagcgtcagagcagaaaaagaaagaaaaaagcagtgaaaagacggagatcaaagcggccggaacggaaggctcggcttcttcatacaacgtctccggggcagataagtataagcttgaactgattgcttctgacagcgcatggatccgcgtccgtgatgacagcggcggttctttaaaagaaggaacgctgcaaaaaggcgaaacctttaaaaaagacgtcacggatcaaaagcagattgaaatccgcacgggctatgcccctaacctgaaaattaaaatcaacggagaggttctgtcctatgaactcaatccgcatgatatgatggcgcagaccatcacaatcaagatgaaaaaataaaaggggaaaaagtcatctgaacgattaagatgactttttcttcacgtccgagtacatattattggaggggctttatgtttaacttaccgaataaaatcacactggcaagaatcgctttaattcctgtatttatgattatcatgcttgttccttttcattggggcagcgttcatataggggatgaatcgattccggtcgcgcatcttacgggagctgttttgttcattatcgcatcaacgactgactgggtggatggctactacgccagaaaactgaacctcgtgacaaacttcgggaaatttttagatccgctggctgacaaactgctggtgtccgcggcattaattacgcttgtgcaatttgaccttgcgccggcgtggatggtcatcatcatcatcagccgcgaatttgccgtaacgggattaagacttgtgctggcgggaacgggggaagttgtagccgccaatatgctggggaaaattaaaacatgggcccagatcatcgctgttgccgcgcttttgctgcataatcttccgtttgagctcgtttctttcccgttcggcgatatcgctttatgggtggccgtgctcttcacagtcatttccggctgggattattttgcgaagaactgggatgcgttaaaaacatctaactaaggaagaaggacttaaagatggaaatagcaaaaaaagcagaaatcattgcggtcggctcggagcttctgctcggccagatcgccaatacgaacgcgcagtttatcagtaaagaactggcggaaatcggtgtaaacgtgttttaccataccgctgtcggtgacaatccggagcggcttaagcaagtcatccgcattgccgaagagcgctcagacctgattattttttcaggcggcctcggaccgaccaaggacgatttgacgaaagaaaccattgcaaacacactggggcgcccgctcgttctgaatgacgaagcgttccggtcgatcgaagaatatttcgcgaaaacaaaacggaccatgtcgccgaataaccgcaaacaggcgctcgtcattgagggctcggacgttttggcgaatcatttcggcatggcgccgggaatgcttgcagagcacggctcaaggctttatatgctgcttcccgggccgccgagcgagctgcgtccgatgtttgaaaatgaagcgaaaccgctgcttcttaaaaagcttggttctaatgagaaaatcgtttcaaccgtgctgcggtttttcggaatcggtgaatcccagcttgaagctgatttagaagatatcattgacgcgcagacgaatccgacgattgcgccgcttgctgctgacggcgaggtcacgctgcgtttaacggcgaaacatgctgacgaaaaagaaacagaacggcttttaaaagaaacggaagccgccattttagaacgtgtcggtgaatttttctacggatatgatgatacgtccctggtgaaggagctttcaaaagcatgcagacaaaacaaaatcacgatttcttctgccgaaagctttacaggcggcttgttttcagagtgggtgactgatttaagcggtgcgtctcaactatttgcaggaggtgttgtctgctattccgacagcgtgaaacagcatgtgctcggcgtgaaagctgagacgctcgcagaaagcggagcggtcagcaaagagtgtgcgaaagagcttgcatccggtgtgagaaagctgaccggaagcgatatcggcatcagctttaccggggtcgcgggtcccgacccgcaggaagggcatgcgccgggccgcgtctttatcggcatttcagcggaaggaaaagaagaggtgcacgaatttcactttgccggctcaagaaccggaatcagaaagcgcgccgctaaatacggctgccatctcattttaaaaatgctggatcaaaaataaagttttaaagagcttttttctctgatttttaagtttcataagggaaattatgctcttttgcagaaaagcgaacgcggaaaaaatccgaatatgcgttcgcttttttcttggcaaatgccagtaaacaaggtatagtatatgtagtggcaagataaaggaggaaaaaataaatgagtgatcgtcaggcagccttagatatggctcttaagcaaatagaaaaacaattcggcaaaggttccatcatgaagctcggagaaaaaacggatacaagaatttcaacggtgccaagcggctcccttgcacttgatactgctctcggaataggcggatacccgcgcggacggattattgaagtatacggacctgaaagttcaggtaaaacgactgtagcgcttcacgcaatcgctgaggttcaggaaaaaggcggacaggcagcatttattgatgctgagcatgctcttgatcctgtttacgcgcaaaagctcggtgtcaatatcgaagagcttctgctttctcagccggatacgggggagcaggcgcttgagattgctgaagcgctggtgcgaagcggagctgttgatatcgtagtcgttgactctgttgcggcgcttgttccaaaagctgaaattgaaggtgacatgggtgattcacacgtcggtttacaggcgcgtcttatgtctcaggcgctccgtaagctttccggcgccatcaataaatctaaaacaatcgcaatctttattaaccagattcgtgaaaaagtcggcgttatgttcggaaatccggagacgacaccgggcggccgcgcgctgaaattctattcttccgtgcgtcttgaagtgcgccgtgccgagcaattaaagcagggcaacgacgtgatggggaataaaacgagaattaaagtcgtaaaaaacaaagtcgctcctccgttccgtacggctgaagtggacattatgtacggtgaaggaatctccaaagaaggggaaatcatcgaccttggaactgaactggatatcgtgcaaaaaagcggttcgtggtattcttatgaagaagaacgcctcggtcagggccgtgaaaacgccaagcagttcttaaaagaaaataaagacatcatgctgatgattcaggaacaaatccgtgaatattacggtttagacaataacggtgtaacggacaaagcggaagaagttcaggaagagatggaattagaagaataaaaacacgatcaaaagagcggaataagcaatttccgctcttttttttgtatgtttcaaaaaaacactggctgtttcggaaaattttatctggaatgttacaacttttttcacccttcactcgtctaacatcatggcgaaagttgaaattatatctgaggaggaaaaaagatgacgagcccccgccgcacaagaataaataaaaaaagaaagaagaagctgatgaaaacgggagggctgtttctttttctgctgcttgtcactgtttttattatgatctggaccgtcacagcgcatcatcgggagaaggaatccgttaaaaacgctcccgccgctcaatctgatacttcaaaagaccagactcaacagaaaaaagaaaagacgcaaaaagagaaaacacctaaatcaatcgatcacaataaacagatcagcaattacttgcaacagatcgggttcagcggcacagcaatgatcgtaaaagatggaaaagttgtgctgaaaaaaggctttggctatgcagaccgaaaacaaaaaattaaaaacaatccggagacatcatattatatcggttcttcacaaaaagcgttaatcgcgacggctgtcctgcagcttgaagaaaaagggctgctgcagacgagtgaccccgtcagtacatacttgccgaattttcctaacggcacgcgcatcacattgaaaaacctgctcaatcatacgtccggcataaacgggcatattgagggtcggggaccgatttctccaattgatttaatcaaggatatagaataccgcggaattaaaaggcagcccggggtttgggattacagggattccaactattcagtgcttgcttatatcgcatctcaggtcagcggggagtcttatgaacaatatataaaagaacacgtgttcaaaccggccggaatgaagcatgccggattttacaaaacatttgctgaagccaaatatcctgccgtcggctacaaagtcgatgagagcggcagtcttgtaacgccgcaccttttggacttatcgcagctttacggggcgggcgacatgtatatgagcgctgaagatctttataaatttgataaagcgatcgtaaacggcacgctcctttcaaaagaaagcttcacaaaaatgtttacagcaggaagcagtgccgcttacgggatggggttttacattgatccgggcagctattccaatcacggtgttatgcccggttacaacattttaaacagtttcagccattcggcaagcaaatatgtcatattactgtcaaacattcagaataacgccaaattaggacaggtaaacaatagaatttaccaattgcttaaccaggcggactgacagagccgtcattcacgaaaagcggatgaaggtatggtatgatatatacatgggcggcgatccgagctgaaggcgaatcgttaagctggcaagcttgacaagtatttccgacacaattacaatgaagttgtaacatttgtttttttaacatgattgttaaaccatttaaacttgacaagggcatgagagactcattccctgtgaaggttctgtatgttgagaaaatcagacaatgtacatgccggcacttatttaagcaaaaaccaagttcatagcaagaggaggtgaaagtatgaccccaatgacggttctcatctccattttgctgactctgctcggtttagttgttggctactatgttcgtaaaaccattgccgaagcaaagattgcgggcgcacgcggtgctgccgagcaaatccttgaagatgcaaagcgtgatgctgaagcactgaaaaaagaagctctgcttgaagcaaaggacgaaatccatacacttcgaatagatgctgaacaggaagttcgtgaaagacgaaatgagcttcaaaaacaagaaaaccgtttacttcaaaaagaagaaaatcttgaccgtaaacatgaaggaattgataaacgggaagcgatgttggagaagaaagatcattctctgaatgaacgacaacaacatattgaagagatggaaagcaaagtggatgagatgattcgtatgcagcagtcagaactcgaacgcatttcgagcctgacacgggatgaagcgaaacaaatcattcttgaccgggttgaaaatgagctttcacatgacatcgccatcatgacaaaagaaaccgaaaaccgtgcgaaagaagaggcagataaaaaggcgaaaaacattctgtcgcttgctttgcagcgctgtgcagcagatcatgttgccgaaacgacggtatcggtcgtcaatcttccgaatgatgagatgaaaggacgtatcatcggccgtgaagggcgtaacattcgtacgcttgaaacgcttacaggtattgacctgattattgatgacacacctgaagcagtcattctttccggatttgatccgatcagacgggagacggcaagaatcgctcttgataaactcgttcaggatggccgtattcatccggcgcgcattgaagaaatggttgaaaaatcccgccgtgaggttgatgactatatccgggaaatgggtgagcagacgacgtttgaagtcggcgttcacggacttcacccggatctgatcaagatcctcggccggttgaaattccgtacaagctacgggcagaacgtactgaaacattctatggaagttgcgtttttagccggtttaatggcttccgagcttggagaagatgcaaagcttgccaagcgtgccggtcttctgcatgacatcggaaaagcaattgaccatgaagtggaaggaagccacgtggaaatcggagtggagcttgcgaccaaatataaagagcatccagtcgtcattaacagtattgcgtcacaccacggagacgaagagccgacttccattatcgccgttctggttgctgccgctgatgcactgtcagccgcaagaccgggcgcgagaagtgaaacgctcgaaaactatatccgcagacttgaaaagcttgaagaaatctccgagtcttacgaaggtgttgaaaaatcatttgcgattcaggccggccgtgaagttcgcatcatggtgaagccggactccattaatgatttagaagcccatcgtttggcgcgtgatatccgtaaacgaattgaggacgagcttgattatccgggacacattaaagtgaccgtgatcagagaaactcgagccgtagagtatgcaaaataaagtgatgcttagcgcatcactttatttttttgagtccctgaaaaggaaggaatggaatgtatgagaattttatttatcggagatgttgtcggttccccgggccgcgacatggtaaaagaatatgtcccgaaactgaaagcgaaacataaaccgcattttacaattattaacggagaaaatgcagcacacggaaaaggactgacggaaaagatctaccacagcctgatggaagcgggagccgacgccattacaatgggaaaccatacgtgggataaaagagagatcttcgactttattgatgatgtgccgcatcttgtccggccggcgaatttcccggaaggtacgccgggcaaaggcattacttatattaaatcgaacggaaaagagcttgccgtcattaatttacaggggcggacgtttcttccgccgcttgatgatccgtttgctaaagcggatgaattaatagaagaagcgaaaaagcgcacaccgtacatttttattgattttcacgcggaagcgacaagcgaaaaaattgcgatcggctggtatacagacggaagagcctctgccgtggtaggcacccatacacacgtgcaaacggcagataaccgcattttgccgaaaggaacggcatatattactgatgtaggcatgacgggtccgtacgacggaattctcggtatggacagagaaacggtcatcaagcggtttaaaaccaatcttcccgtccggtttacggtggcggaaggtaaaactacgctgagcggagtgctcattgacatcgacgatcaaacgaaaaaggccgtaaatatcgaacggatattaatcaatgatgaccatatgttctttgaataggtgatcatgtgtttattttataaaaatattaaaaggaaaagcaggaatatagcaacttcttagtgaatatagtagaaatggaaggtagcccgctatttttgaaaagcattgtggggatggctttttggatagcaacatctaataatgattgttctaatgaacactcacttatccattgtaaaactaagggggagcagaaatggaaatcttaaaagtttcagcaaaatcaagtccaaattcagtagcaggcgcgcttgccggcgtattgagagaacgcggagccgccgaaattcaagcaattggggcgggtgccttaaaccaggctgttaaagcggttgcgattgccagaggctttgtcgcgccaagcggcgtagatttgatttgtattccggcttttacagatatacagattgacggagaagaaagaacggcgattaagttaatcgtcgaaccccgttaaaaacaaaaatatgtacattctcaacctgcttgcgtaaggcgagcaggttgtttttattgctgtcatattttctcacaatattatattgatagtacgaagagatgataaatggctttattcatataatattcaaaaaaaatcccgcccatttttccggacggaagcagttgttttcctcgagtggacactggtgtttacctcctttttatctcatgttacaatccagttattacagtgttttttcgaggaggagtgtacatgttgggaggaaagatgaaagctatcgttaaaaatgaaaacgctttcggagcaacgctgaaagaaattcccataccttccattaatgagaatgaagttctcattaaagtacaggccgcatctatatgcggtacagatgtgcatatttataattgggatcaatgggcgcagaaacgaatcaaaacacctcaagtattcggacatgaattcagcggtatcgtagcggaaacgggcaagcacgtcacaaatgtcaaaataggtgactacgtttcggctgaaacccacttcgtctgcggtacttgtgtcccgtgtttaacagaaaaacatcatgtgtgcacccatacaaagatcctcggcgtagatacagccggctccttcgctgaatatgtcaaagtgccggcccgaaatgtttggaaaaaccccgctgatatggaccccgccgtcgcctctgttcaagagccgcttggcaacgcggtgcatacggtgctggaaagcagccggcttgcgggcggttccgctgcaattatcggctgcggaccgatcgggctgatggcggtggcggtggctaaagcggccggtgcatcccgtattgcggccattgataaaaatgattacaggctggctcttgcgaagaaattgggagctgcgatcaccatttcagttgatgaggaagatccgcttgaggtgatcgacaccttaacaggcggtgaagggatcgaccttgtctgcgaaatgtcaggccacccggcagccataacacaaggattaaagatggcggccaacgggggaaggttccacatgctgagtctgccggaacgtccggtgacggttgacctgacaaatgacgtggtgtttaaaggacttaccgtccaaggcatcacaggcagaaaaatgtttgaaacatggcggcaggtatcgcacctgcttgaatccggccttgttgatctgacgccggtgatcacgcatcagtttccgcttgaagactttgaaaaagggtttgacctgatgagaaagggacagtgcggcaaagtcattttgattccataaggggagggttctataatgaaagaatttgaatttctaaaagcagagcttgataaaatgaaagaaaataaaacgtggcagcaaatgaaacaaattgaaacgaagcagggtccgtcggtggaagtcaaaggggaaaacgtgatacagctttcatcgaacaattatctcggtttgacgtcgcatccaagacttgtcgaagcggccaaacgcgccgcggaagaattcggagcgggtacggggtccgtccgtacaatcgccggaacattcacaatgcacaatgagctggagaaaaaattggcaacctttaaaaaaacagaagcggcacttgtttttcaatcggggttcacaacgaatcagggcgtcttatcaagcattcttacaaaagaagatatcgtgatctctgacgaactgaaccatgcttccattattgacgggatcaggctgacaaaagcagataaaaaggtgtaccgccatgttgatatggacgatttggaaagggtgctgaaaaaatcaatgaattaccgcatgcgcctgatcgtcaccgacggcgtattctcaatggacggcaacatcgctcctttgcctgacatcgtcaaacttgcagaggcgtacgatgcctttgtgatggtcgacgatgcgcatgcttccggcgtactcggaaaaaacggaagggggacggttaatcacttcgggcttgacggaagagtccacatacaggtgggcacattaagcaaagccatcggagtgcttggcggttacgccgcagggtcgcaggttctgatcgattacctgcgccataaagggcgtcctttcttattcagcacttctcatccgcctgcagtaacggccgcatgcatagaagccattgacgtcctgctggaagagcctgagcatatggaaaagctatgggagaacacggcgtatttcaaagacaaactggttcaaatggggctgaccctcacaaaaagcgaaacaccgatcgtgccgatattaataggggaggaagaaaaagcccaggcattatcagaccttttattgacccgcggcgtgtttgcacaaagcatcgtgtatccgacggtcgcccaaggaaaagcgagaatccgcaccattattacggcggagcatacaaaagaggagcttgaccgggccctggaagtaatccgttcagccgcaaaagagcttcagcttgtgtaagggggaaatgattccctcttttttatttcttattgattcttattctcaataaggtgtacaataataggctggcggttgtgccaaacgcttttaaccagtatacttgagggtggaagtttcggttgaaaggagacattcgaacatgaatgaaaagcaaaagcaggaaagcggacaagtgaatccggcggacaaaaaatccgaaaaggattacagcaagtattttgaagccgtatatattccgccttctttaaaagatgcgaaaaaacggggcaaagaatccgttcaatatcataacgattttaaaatctctgaagaatttaaaggccttggtgaaggcaggaaattttatatccgcacgtacggatgccaaatgaacgagcatgatacggaagtcatggcgggtatttttatggcgctcggttatgaagcgacaaattcggttgatgacgcgaacgttattttattaaacacttgcgccatccgggaaaacgctgaaaacaaagtgttcggagagctcggccatttaaaggcgctcaaaaaaaataacccggacttgattctcggcgtctgcggctgcatgtcacaggaagaatcagtcgtaaaccgcatccttaagaagcacccgtttgtcgatatgattttcggcacgcacaacattcaccgtctgccggaactgttatcagaggcatatttatcaaaagagatggtcattgaagtgtggtcgaaagaaggggatgtcattgagaaccttccgaaagtccgcaacggaaaaattaaaggctgggtcaacattatgtacggctgcgacaagttctgcacatactgcatcgtaccgtatacccgcggaaaagaacgaagccgccgtcctgaggaaattatccaggaagtcagaagacttgcaagcgaaggctataaagaaatcacgctgctcggtcaaaacgtgaatgcgtacggaaaagattttgaggatatgacgtacggtctcggtgatttaatggacgaactgcgtaaaattgatattccgagaatccgattcacgacgagtcatccgcgtgactttgatgatcatctgatcgaagtgctcgccaaaggcggcaaccttttagaccatatccatcttccggttcaatcaggaagctcagcgatgttaaaaatgatggcccgtaaatatgacagagaacgctatctggagcttgtcggaaaaattaaagcggcgatgccgaacgcttcactgacgaccgatattattgtcggttttccgaatgaaacggatgaacaatttgaagaaacgctttcgttatatcgcgaagtggaatttgacagcgcatatacgtttatttactctcctcgtgaaggcacgccggcagcgaagatgaaagacaatgttccgatgagggtcaagaaagaacgtcttcagcgccttaatgatttggtgaaagaaatttcagccaaaaaaatgaaggaatatgaaggcaggactgtcgaagtattagttgagggagaaagcaaaaataaccctgacattcttgccggctatacggaaaaaagcaagctcgtcaacttcaaagggccgaaagacgccatcggcaagattgtacgcgtcaaaatcgaacaggcgaaaacatggtcgcttgacggtgtgatggcaggagaagcaatcgaggtgaaataatgatgacgctttactcaaagaaagacattgtacagcaggctaggaaccttgcgaaaatgatttctgaaacagaagaagttgattttttcaaacgcgccgaggcgcagattaacgaaaatgaaaaagtctctgcgattattaatcagattaaaaccctgcaaaagcaagccgttaacctgaagcactacgaaaagcttgaagcgctgaaacaagtggaaagtaaaattgacgccctgcaggaagagcttgaagggattccgatcatccaggaattcagagattcccagattgaggtcaatgaccttcttcagcttgtcgcacatacgatctcaaatcaggtgacaaacgaaatcattacatctaccggaggcaacctgctgacgggagaaaccggttcaaaagtaaaacattcgaataacagctgttctatttaaacacggggccttcatcggcccgtgttttttttgccgtttaagaactaattgtaatatgtactaaattttcattgtctcaacgttttgtcctatttttactggaaagttttatcatacttaaaagtaaagtttctgggcagggctgcatacaatgaaacagaaactttgtatttttatatttttattataaaaatgcacatgagacaaatgcccagcataagataacacgaagaagaacaaggaggcctgccggaatgtctgaatacagggaaattattacgaaagcggtagttgcgaaaggaagaaaattcacccaatgcaccaacacgatctcgcctggagaaaaaccgtcaagtatactgggcggctggattatcaaccacaagtacgatgccgaaaagatcgggaagactgtagaaattgaagggtattatgatataaacgtctggtactcttacgccgataatacaaaaacggaagttgtaaccgagagagtaaagtatgtcgatgtgattaaactcagatacagagatacaaattacttagatgacgaacacgaagtcattgccaaagtgctgcagcagccgaattgtcttgaagtcaccatttctcctaacggaaataaaatcgtggttcaggcagagagggaatttttagcagaagtggtcggtgaaacgaaagtcgtcgtcgaagtcaatcctgactgggaagaagacgatgatgatgattgggaagacgatcttgacgaagaattagaggacattaaccctgaatttttagtcggagatcctgaagaataagttgaggctaggggagtttaacaccccgagtctcttttttatatataaagatatcactcttttgtttatgttataatgggattcggataagagaagatacatagtgagggattaaatgatggctagttacacgcctatgatacagcaatacttgaagataaaggcagagcaccaagatgcctttttattttttcggcttggtgacttttatgaaatgttttttgaagatgcaaaaaaagcgtcgcaagagcttgaaattacactgacaagcagagacggaggttcggctgataaaattccgatgtgcggcgtgccgtatcattccgcggcggcttatattgaacagctgattaaaaagggctataaagtggcgatctgtgagcagacggaagatccgaaggcggctaaaggcgttgtaaaaagagaagtcgtccagctgatcaccccgggaaccgtgatggatggaaaaggcatccatgagtcggaaaacaactttatcgcttccgtttccgaatttcgtaacggatacggtctcgctttatcagacttaacgaccggagaaaacctggccgtatttattgagcggattgaagatgtcatgtcagaaatttactcagtcggcgcaaaggaaattgtcgtatcaagcaagtttaacgaacatacggctgctcagctgaaagaacggtgcggcgcaacgatttctatcgaagacggggaaataacagaacgcattgaaatcgcaaagcacttgccgggcgaagagctgacagagacgtttatgcgtttatatacgtatttgcagaaaacgcaaaaacggagcctggatcatctgcagccggttcaagtatatgaattggaagaagcgatgaaaattgacctgtattcaaaacggaatcttgagctgacggaaacgatccgttcgaaaagcaaaaaagggtcattgctttggcttttagacgagacgaaaacagcgatgggcggccggcttctcaaacaatggattgaccgcccgctgatcagggcatcccaaatcgaagaacgccaggaaatggtcgagacgctgatcaatcatctgtttgagcgcgaagatctgcgcgagcgcctgaaggaagtatacgatttagaacgtctggcgggccgggtcgcattcggaaacgtcaacgcaagagatttaatccagctgaaagaatctttaaaacaagtgccgagcattaaagagcttgtaggatctcttaaccataaaaaagcaaaagaacgcgccggcttgattgatccgtgcggagatttgcttgacctgttagaagaagcccttcatgaaaacccgccgttatcgttaaaagaaggcaacttaattaaagacggctatcatcagaagctcgatgagtaccgtgacgccagcaaaaacggtaaagactggattgccagactggagcagcaggaacgcgcttatacgggcatccgttcattaaaggtcggtttcaataaagtgttcggctattatattgaagtcacaaaagcaaaccttcatctgcttgaggacgggcggtatgagcggaagcagaccctcacaaacgccgaacggtacattacgccggaattgaaggaaaaagaagcgcttattttagaagcggaaaacaacatctgcgagctggaatatgagctttttgccggtctgcgtgaaaaggtgaaacaatttattccgcgtctgcagcgtcttgccaaacaaatgagtgagctggatgcgctgcaatgctttgctacgatcagtgaaaacaggcattacacaaagcccgtcttttctgataatgaagtaaaagtcattgaagggagacaccccgtcgttgaaaaggtgatggacagtcaagaatacgtgccgaacaactgcctgatgggcgattcgcgggaaatgctccttattacgggtccgaatatgtcaggtaaaagcacgtacatgagacagatcgcacttctatcgatcatggcccaaatcggctgttttgtgcccgcaaaagaagcggttctgccgatttttgatcaaatcttcacgagaatcggggcggcggatgatttgatttccggacaaagcacctttatggtggaaatgctggaagcgaaaaacgcgattgtgaacgccacaaaagacagcctgatcctgtttgatgaaatcggccgcgggacatcaacgtacgacggaatggcgctggcacaggcgattattgaatatgttcatgatcatatcggcgctaaaacactattcagcacgcattatcatgagctgacggtgcttgaagataagcttcctcagctgaaaaacgttcatgtgcgcgcagaggaatataacggaacggtcgtgtttctccatcaaatcaaagaaggagccgcagataaaagttacggcattcatgtcgcccagcttgcggagctcccggacgatctgatcagccgcgcgcaggagattttgaaacagcttgagcagacgggagataaaccggagcttccggcggcacctgagaaaaagcccgccgtcaaagaagaaccggcacagctgtccttttttgctgacggtgaaaaagaacagaaggcaccggctgtttctaataaagaaaaacaagtgcttgaagcttttaagtcaatcaatattctcgatatgacgccgcttgaggcgatgaatgaaatgtacaagctgcaaaaaaaattaaaatagaaagaggtgacggacttggcaaaagtcatccagctgtcagatgaactttcgaataaaatagcggccggcgaggtggtcgaacggcctgcctcagtcgttaaagaattggtggaaaacgccatcgacgcaaacagcacagtcattgaaatcgacatagaggaagcggggctttcgtcgattcgggtgctcgataacggcgaagggatggaaaccgatgattgcaagcgggctttccgccgccacgcgaccagcaaaatcaaagatgaaaacgacctgttccgggtgagaacactcggtttccgcggagaagctttgccaagtatcgcgtctgtttctcatctggaaatcaaaacgagcatcggcgagggggcgggaacccatctcattcttcagggcgggaatatcatttctgaacagaaatcctccagcagaaaaggaacggagattatcgttaccaacctgtttttcaatacgcccgccagattgaaatatatgaaaaccgtgcatacggagctcggcaatattacggatgttgtcaaccggattgctcttgcgcatccggaagtatccatccgtctccgccatcaggggaaaaatctgttgcagacaaacggtaacggggacgtgcgccatgtgctggccgcaatttacgggacggcggttgcgaaaaaaatgataccgctccatgtcagctcgcttgattttgaagtcaagggctacatcgcgcttccagaaatcacgcgtgcatccagaaactatatgtcatctgtcattaacggcagatacattaagaatttcccgcttgtaaaagcggtgcatgagggctatcacacacttctgccgatcggccgccatccgattacgtttatcgaaattacgatggacccgattttggtcgatgtcaatgtccatccgtcgaagcttgaagtccgcctcagcaaagagacggagctgcatgagctgatccgtgacgggataaaggaagtgtttcaaaagcagcggcttattccgagcgcccagctcccgaaaaaaacagcgccggcaccggccaaaaacgaacagcaatttatgacattcgaggaaagcgcgcctgagcggaaacttcctgaaaaaacgccggagccgtcttactcaccgatgaagctgagttcggtcgtaaaagagccggagccggtcatagaagaagagtccctgccggatgaagcaggtcacggagtgccgccggagctcggcatgccggtaacggaagcgcctgtttccgatattccggagcctgaagaggaggctgactctgaagaaatacgggaagaaagagttccggtgatgtatccgatcggccaaatgcacgggacgtatattttagcccaaaacgaaaacggcttgtatatcattgaccagcatgcggcgcaagaacggattaaatacgaatatttccgggagaaagtcgggcaggtcgagcctgaagtgcaggatatgatcgtgccgctcacctttcattatgcggcaaatgaagcgctgatcattgaccagcatcagcatgagcttgaaagcgtcggagtatttttagaagcattcggcacgaacagctacatcgtccgctgccatccggcctggtttccaaaaggggaagaagctgaactgattgaagaaatcattcagcaggtgcttgacgccaaacagatcgatattaaaaaactcagggaggaagcggccattatgatgagctgcaaaggctcaatcaaagcgaaccgccatttgagaaacgacgaaatcaaagcgctcttggacgacctgcgccgaacgacagacccgttcacatgcccgcacggccggccgatcattatccaccacagtacgtatgaaatggagaagatgtttaagcgtgtgatgtaataacaacgtttatgtgagactaaactgttatttacccacaagcagccttactagtttgaatgacccagcctttcagagataacttttgagttctggcataattgttgcatggtataccgtaaatcatgaagataatttgtttaacatccagttatttgggaaggatccctgaagtacaagatgaatactctgtatgcgggtacctgcttttacaaagtcacagggaagagatggggaagaatttaaataaaattggaatttggcgggttatactatccgcaagtcagtcaagggggactagtgattagcccccttacatttagttcttcctgcggtattttctatttttgatcaaactgaaaaccactaagagaaccacaccgacagcaacaatataaaatgaaatttccgctgcggcggtgttaatattcttaaggacaaggataagccctattaaaattataggaatgatgtaagttagaattcttatagctttcgggctcggttcagcattacttttatcttccatagttacctccgatcttaaacactttagaaaataatcactttaaagcttaacacaggataaatttgttaaacaccaacaatagccccatttaaaggaaaagcataagagttttagtaacccacaaagttgctgcctggttaccagttacttttagagcatccgcatagcacgcatcttcaactgcaccagtaaaattgtcaatgatattaagaattatttcaaaaccgccgattccacccatagcagctttaactttagtaggtattgcgtcccgagctgctctcagtgcttttatagctcaggacaaatcaccttgaacagtaaactccgacccatatcacatagtctatttgtctaaatcttaatatttactttttacacagtaaaaagataactttatttagccctaacaaaaacatctgagctccttgtcaataatcaaatataaatcgtcttcaactgacgtcttttttcatgcgcgacgctttcgtgaattgttgcagctagactggtttttgaacggttttctcgcaaaaaaaaagagtgtaaattaagctgtacttttctcagttcaattatgttaatgtcaacataacgttgaattcggtgtaagaactaaggtattctgatatatttcgagagcccgtgtggtttagtttatctgaagaaaaggattgaaataataatcttaattgcgggtcatttctaaaaactgattatctcctccggccgcttctgtaattgcttctcaaaacaaaagttcaatttgttttctttttatccgaaactcatattcatccttcattttctgaataaaattccctaaagaattcatctgaattaatattctgatttccttatatatcagcatagcaatttgtaaaaaaggcccagactggtgcttttggcgggagcagaaagttttttaaactttaccggaaaatccatggaaaaacgtggtgccatctggtaaagtggttacagtcggctgggcggcggcagcagtctgcccggatcttttaaatgggaatggtgacaatggatcatacatatgaagtgcatcaaatcaaaacttatcaccagatgtggtccaactattgttatattatcgcagaccgctcaaaaaaatctgcgatagcggtggacccgtcctgggaaatcgataaaataaccgataaactgcatgaattggatgttgatttatcagctattttattaacacattcgcattatgaccatgtaaacttggcggagccgcttcagcaaatctatcattctgatatatacatgtcgtcggcggaaatcgatttctatcaattccggtgcagaaacttaatagcgcttgaagacggacaaacctttgcggccggagggtttatcatcagaagtatattgaccccgggacatacggccgggggaatgtgctatttgctatctgatcacctttttaccggtgataccgtgtttacagaagggtgcggtatatgtgaggacaggggcagctcagctgaagatatgtttcacagtatacagaggatcaaagcctctattccgccgcatgtgcgtgtgtatccggggcactccttcggggagaagccgggtcaaaaaatggagagtcttttgaaaaacaatatttactttcagattgaaaaaaaagaacatttcgtgaatttccgcaacagaaaaaatcaaaaagggctgtttcactttaagtagcgtataatttggttctatctaactagtttttcttttaggccacggaacttctgaattgaaatgatagtcattgctcgctttttggtgatgaatggctgagtaacggtagtttgcggataaaagcgccgggcaggctgaatgggacattctgcttatgtctattccaaaagccctgagtccgccttccgtcagggaaaaataggcattattcaggattccgcataggataaattaacttgacatggtatttttgtgaagttactatcaacttgaacatgcttcttaactgaatccgagaaaggatggctgagaaaatgatcacatacatattccccggacaaggttctcaaaagcagggaatgggaagctcattgtttgatgaatttaaagacttaacggagcaggctgatgaaacactcggatattccatgaaacggctttgtcttgagaatccgtattccaatcttcacaagacgcagttcacccagcctgctttatatgttgtaaacgcgttaagctatttgaaaaaaatccaagaaaatgacataaagccggattatttggccggccacagtttgggagaatataatgcgctgtttgcagcaggtgcttttgattttattaccggcctgcagcttgtccgtaaaagaggcgaattaatgagtatggccactgacggaaaaatggccgccgttatggggttaaccgcagctcaagtgtcggacgcccttcaaacgcacggattacatacgattgatattgccaatatgaattctcctcaccaagttgtcatatccggacgcaaagaagacattgaaagagccaaaagcgtattcgaaggaataaaggacgttacgatgtttcatccgttaaacgtcagcggcgcttttcactcgagatatatgagcgaagcaaaacaagagttcgaaaaatttttacagtcatttcatttttctgctatatcaattcctgtcatttctaatgtgcatgccaggccttatgagcaagacggaatccactccgttctggccgatcagatcgaccattcagtgcgatggaacgacagcatgcgctatctgctggacaaagggcggatggaatttgaagaagtcggcccgggccatgtgctgacaggacttattcaccgcatcaaaaaagaaactgaagcttcacccgccatgtagcggaacgcaagtcaaaattcttatctcacataatagtgccagccatacaacatcacgaccacttcacctgcacacaacatcaagaaaaacttacaaatcaatattttaaaaaaataaagagcaaaaaggagaacaaatgaaccagccaattgttttcatgttttctggacagggttcccaatactatcaaatggggaaagagctgtttgcacataacgccgcttttcggcagaaaatgcttgacttggacgattttgcagtcagccgtttcggttactctgtcctgaaagaggtttatcatacaggcaatcgtctgtctgatccatttgaccgccttcttttcagccatcctgccatttttatggctgagtacgcacttgcatatgctttggagcaaagaggcatacgtcccgattatgtgatcggagcaagccttggagagtatgcagcggccgctgtgtcgggtgtgctgagcgctgaggatgctttagattgcgtgctggaacaggcccgaatcattacggaaacttgccgtaacggcagcatgcttgcgatactgggtgatccggctttatatcaagatgatccgctgctcggcgaacatagtgaattggcatctgtaaactatcattctcactttgtcatctcgggagagcgggaacatatcaaaaagatcatggacgatctgagagaaaagcagattcctcatcagctattgccggtatcttacgggtttcactcagcgctggttgatcaggcggaacagccgtacaagcgctttttagctcagaaattaatccggactccgtttataccgtacatctccagtgcgaccggagaggctgagaccgatatacaagcggactttttctgggatattgtaagaaagccgattcaattccgcgaagcgcttcaattcgcagacagccgccaaaaaggattgtatatcgatgccgggccttccggaacgttggccgcatttgccaaacagattcttcccgcaggatcggctgaacgcatccgtgccattatgacgccgtttcataaagaacaaacccatttgcagcaaatagaagacagcattttatcaccgcccggaaggagactgtaagatgatcagctttgtttttccaggccaaggctcgcaaaaaatagggatgggagaggacctgttcggccgctatcctgaattaaccgcaaaggcggatcacattctcggatattccattcaggagctgtgccgggacggagaacgtctcaatcagactcaattcactcagccggcgctctatgtcgtcaatgccctcagttatttgaaaaaaacagaagaaaccggcttgaaaccggattttaccgccggacacagtttaggcgaatataacgcgttatacgcctcgggcgcttttgattttgaagaaggcctacagctggtcaaaaaaaggggcgacctgatgagccgcgcaaaaggaggcggcatggcagcggtgatcggcctgactcatgagcaggtgacggacgttttaagggagtatcacttgcatacgattgatatcgccaacatgaacactccgcagcaaattgtcatttccggatataaagaagatattgaaaaagccgcatccgtttttgaagccgtaaacggcgtaaaaatggttcaccgcttaaatgtcagcggcgcctttcattccagatacatgctggaagcgaaggaggaattttcacggtttattgaaactttccattttaagccgctgtccattccggtcatttcaaatgtgacggcaagaccttatgagcagaccgagctgaaaaagacactcaccggacaaataacgggatcggtgaactggacagacagcatccgttttttaatgggaagaaagaacatgatctttgaggaaatcggtcccggaaaagtgctgacggggctgattcaaagaattacggctgaagcggagccgataacagatgaaatcaaagtcccggctgaagctggaaaaagctcaattacggcggagtctttaggaaatgaagagtttaagcgcgattatcaattgaaatacgcctacttggccggcggcatgtaccgcggaatttcttcgaaggaaatggtcgtcaaactggccgaaaaaggaatgatgggctttttcggaacgggcggtttgaacatcgcgcacgttgaggacgccattttgtcaattcagcatgagcttcgtgacggcggttcctttggcataaatgttgtacataacatgaagcatacagattcagaagaaaaaatgattgatcttttactgaagcatggggttcagaacttggaagcatcagcatttttaacggttactcctgctttagtaaggtttcgcgctaaggggttaaaacgcggtgccggcggacaaataatagcgcgtcagcggattatcgcaaagctgtcccgtccggaagtagcggaagcatttctcagcccggcgcctgatcacattctgcagaaacttgcagccgaaaacaaaattaccgctgaagaagcaagtctgatgagagaaatacccgttgcgcatgacatctgcgtagaggctgattcaggcggccacactgacggcggagttgcttacagtctcatgccggcgatcatccgtttacgagatgacatgatgaaaaaataccgatacggcaaaaccgtccgcatcggagccgcagggggaatcggaacgcctgaggctgctatggccgcatttatgctcggcgctgattttattgtgaccggatccattaaccaatgcaccgttgaagcagcgacgagcggcctcgtaaaggatctcctgcagcagatgaatgtacaggacacggcctacgcgccggccggcgatatgtttgaatcaggcagcaaggtgcaggtattaaagaaagggctgttctttccgacccgggcctctaagctgcatgaactgtatcagcgtcaccgctcaattgaagaaattgatgaaaagacactcagacaaatagaagagaagtattttaaggcaagtgtaagcagtatttatgacaaagtgaaggctcattattcgaatgaagacatttcaaaagccgaacggaatccgaaacagaaaatggcgctcatattcaaatggtatttcaggcaaagctctgcttcggcgattaaaggagacccggatgccaaggtagacttccagattcattgcggcccggcattaggcgcctttaatcaatgggtgaaaggtacggagctggagtcctggaaaaaccgccatgccgatggtatcggccttcgtcttatggaagagacggcctcgcttttgaatcagaagttaggctcatttctgcaaacgtgttgacaagacgaaatgatagattgaaaacatggaatattcataaaagatgaaacagggaggaactgacaatgagtgaagaaagaatctttgaattgctgcagaacacaatctacgaggttttgcctgatttagaaggcgaacagctttcaaaggaagaccggttagttgatctgggggcggactcagtggaccgcgccgaaattatcacgatgatgcttgaagaattatcactgcagatcccgcgtgttgagctgacgggagtgtcaaacatcggcgaattggcggcaaagctttatgaaaaggtacaggctgtctgataaaacggtgaaaaaatcggaaactcaaaattcatattggaggcgaagttcatggcggctgccggaatagaagcgataaatgtgtttggcgggacggcataccttgatgtcatgcagctggcggagtacagaaacttagaccctgccagatttgagaatttactgatgaaagaaaaagcggtggcgcttccgtacgaagaccccgtcacattcggcgttaatgcggcaaagccgattatcgaccgattgacagaggctgaaaaagacagaatcgagctgctgattacctgctcggagtccggcatcgacttcggaaaatcactcagtacatatattcatgattatttaggcctcaaccggaactgccgtttatttgaactgaagcaggcctgttattcaggaacggcgggtttgcagatggcgcttaattttattttgtcgcagacatcccccggagcgaaggcgcttgtcgtcgcgacggatatttcccggtttttaattgccgaaggcggcgatgcgttaagcgaggattggtcttacgccgaaccgagcgccggagcgggtgccgtcgccttattgatcggtgaaaacccaatcgtatttcaggcggatgcgggcgccaacggctattacggctatgaggtgatggatacatgccgtccgatcccggacagtgaagccggtgacgccgacttgtcattgatgtcttatctcgattgctgcgaacagacatttcgcgagtacaaaaaccgtgtgccgggcgctgactataaagagacgtttcactatcttgccttccatacaccgtttggcggcatggtcaaaggagctcaccggacgatgatgcgtaagcttgcaaaagcgaaaaacgctgagatcgaacaggattttcaaaccagggtagagccggggctccgctactgccaaagagtcggaaacattatgggggcagcctctttactggctcttgcaagcacgattgatcaaggggctttcgacacttctaagcggatcggctgtttctcgtacggctccggatgctgttcagaattttacagcggcgttgtgacgcctgaaggacaaacgcggcagcattctttcaaaatagaagagcatctgaacaacagatacaggctgtccatggaagagtatgaagaactgtttaaaggcagcggtctggtgaagttcggaacccggaatgtcaaattggatatgaatatgattccgaacattttagaccatcatgccgggagccctcgtttatatttggaagaaatcacggaatttcatcggaaatacaggtggatcccgtgacctatgagacgatcaacgtccgttttcagcaaaatgtctgcttcatcacctttgatcggcctgaagccaacaatacgattaatgagcgtttagtggaggaatgcctgcacgttcttactgaatgtgaagactccgtgacctccgtagtgcttgaagggcagccggaggtattttgtttcggggcggattttgatgagatgtaccggaaaatgaggcagggaatgcagcatgcggaatcgcaggagccgctttaccgtttgtggctggcattaaaatccgggccgtacatcacaatcgcccgcgtccgcggaaaagtaaatgcgggaggtgtcggttttgccgccgcctgcgatatcgtcattgcagaggagagtgcttcgttcagtttatctgaactgttattcggactttatccagcctgcgttctgccgtttttaattcaaagaatcggatttcaaaaggctcattatatgacgatcatgacaaagcccgtgccggcacgccaggcgcttgaatggggactttgtgacgtatgcgtcccggactcagcaacagagctgagaaagcatttgctgcgtcttcgcccgctgtcgaaaaaagcagtcatccgctataaaaaatacatggattccttaaacgaccttgttcatcgttcgaaatccattgctctagccgaaaatcaagcgatgttttcagatccggataaccaatcagccattttccgttatgcagaaacggggcggcttccttgggaaacggagaacagttaggaggatatcatgccgaacgccgcagttgaactgctcgaaattgaaccggatattatccaagtgacaatgcaggataaagcccataaaaacgctttctccaaagaactgacggatggattgatggaagcattcacccgtataaaaaaatcgtcagtctataaagctgtgattttaacaggatacggccattactttgcttccggaggcacacaggaaggtctgctcaggattcagcagggcatcacgaagtttacggaagaccgcatgtattctttggcgctggaatgtgatatccccgttatttcagccatgcagggccacggaatcggaggcgggtttgtcatggggcttttcagtgattttgtcattttaagcaaagaaagcgtgtataccgcaaactttatgaaatacggtttcactcccggaatgggggctacctttatcgttccggagaagcttggggcaagcctcggccatgaaatgctgttaaacggcggccactaccgcggcggtgacctggagaaaagaggagtgccttttccggtgcttccgcggcaggaagtattagactatgcgcaggaattggcccgtgagcttgcggaaaaaccgagaaactctttaattacattgaaaaggcacttggtgacgccgtttcgcgagcagcttccggctgtcattgagaaggagttaatcatgcacgatgagacgtttcatgatgatgaagtgaaaaaacgaatcacgacgatgtacggagtataagacatacatcttacatacagatgaaatggaggcagctctatgaaaagtgatatgaaggcaagcgggttactcaagccatctgtcagctacggaaaaccattgcggctttcagcggatcagccgatgacgattcctgaagtcctgcacaaaaccgccgcggcagcgggagatcaaaagggcatcacatatatacagcctgacggcaccaaagtgtaccagacttacagcggcctgaaaaagatcgctctttcgattgtgaaagggctccgccaatcaggagtgaaggctcaggatgaagtcatattacagctcagtgacaattcccagctgattcctgcgttttggggctgtgtttttttaggagcgatcccggttccgcttgcggccgctccggcttatacagaaatgaacagcgggacgcaaaaactgaaagacgcctggacgcttttgaatcagccgtatgtcatcacaagccgtgaagtgctgccggagatgactgaatgggcggaggagcaggagctttccgggttttgcgctttggcggcagaagatctcagtgcgcatgaaatggatacggactgtcatcatccccgtccggaagatttggcgatgctgcttttgacctcgggaagcacgggcacgccgaaagccgtgatgctcagccatgaaaacatcgtctgcatggtcaaaggaaatattcagatgcagggctatacaagtgaggatgtcacgtttaactggatgccttttgaccatgtcggcggcatcggaatgcttcatctgcgtgatgtttatctcggatgtgaggaaatcaacataccgagcgaatccattttgatggatcctttaaaatggctcgacctgattgatcattaccgcgcttcggtcacgtgggcccccaattttgcctttgggctgcttgccgatttcgcagaagagattcaaacacggaaatgggacttatcttccatgcgttatatgctgaacggcggggaggccgcggtggcgaaagtcggacgcagaattatggagcttttagagccgcacggtctgccggctaatgccatccgtcccgcatggggaatgtccgaaacgtcttcgggcgtaattttctcagatgagtttacactggaaaacacgagtgacgacgatcgtttcgtcgagatcggtctgccgatcccggggtttaatatgagaattacggatgaccgcaatcaagtggtggaagaaggagaaatcggccgctttcaagtgtccggtctgactgtaacgagcggatattatgagcgcccggacttaaacgagagtgtctttacagaagacggctggtttgaaacgggagatctcggatttctgcgtgaaggccgcctgacgataacggggcgcacgaaagatgccatcattatcaacggtgtgaattattacagccacgccattgaatcagccgttgaggaattgccggaaattgaaacgtcatatacagcggcatgcgccgtccggccgaatcaaagcacgacagatgagctggcgattttctttgtgacgtctgttccattggatgagaaccgcatgacgaagcttattcatcacattcaccagcacgtgacacagagaatcggcgttacccctgattatctgcttccggtcgcaaaagaagacattcctaagacggcaatcgggaaaatccagcgcactcagctgaaacattcattcgaacaagggcaatttgattcattacataataacagacaagaaggcggcaattcagccccggcttctgcagagaaagaaattgaacgggattttatccgttttctgaaagaggaactttccatcgcggatgagcttgttgatccaaatacaccgtttcaaagccttggcgttaactccatcaagatgatgaaactcgccagatcaattgaaaaaacgtatcacatccggctgacggcaagagagctgcacaaaaacccgacgattggcgctttagcggcttatactgctgaaaaagcggcaaacatgtcagcggagcatcattcccaaaaagccgaaccgccggcagaacgggagagacggcaaacggcgccagcgctttcagaagtccaaaaagggctgtggacattgcagaaaatgtcgcctgaaacgactgcataccatgtcccgctctgtttccgattcacaaccggaatcgacaaagagaaactgaaacaggcgtttcagctcgtattaaagcagcatccgatgctcaaaagcgccgtgaatgaaacagacggcgggttttatttcatagaagcggcagatccttttgtattctcggaagaagatatttctgacgtcaatgaatcacaaatacccgctctgatacggaaaaaagttaaagagccgtttgtcaaagaaggcgggcctttgctgcgcgtgcggctgctttcaaaatccgcctcggaacattatcttttgacggtcattcaccacatcgtgtttgacggtttttcatccattacatttattcacagtctgctggatcattatcaggcgctgctggagggaaaagaagagtttgcggccgccgctcccggcattcattccgatttcgcggcttgggaaaagcggtatttagcgggtgaagaaagcaaagctgcccgcgcttactggatgaaacagctcgggggcgatctgcctgaccttcagcttccgccgatgcgcacgggcagcagcgttccggagtttacagaagatacgctgacacgccgtcttcccgaacggctgctgaataatctaacggcgtttgccgcatcccgttcgattcatttgtctaccgttatgctgagctgctatatggtgcttttaagcaaatatacagataaggaagatattgtgacaggcatgcctgcgatggtcagacctgaagaacgctttgacggagtggtcggccatttcctcaacatgcttcctatacggagcagagccggacgaaaagaaacatttgctgactttgttcaaaaggtgcaggatgccgttctggacggactggatcactccttttatccgtttccgaaaatggtgcgtgatgtgcatgcgaaacccctgcagaacggttcgcctgttttcagcaatgcctttttctatcagaactttctgcagtattcaagctatcaatcgatgctggatgaatacaaggaattctcctgtgagtttgtaaaagacattcatcaggagggggaatatgatcttgtatttgaaatgtgggaagaagcatcaggcatggatcttacgattaaatacagcaccgaattattcgacgaagcaggggcggccagacttttcagccaatttgtacaggccgctgaagctttgacggcgaatccggatatgccgcttgagaacgtttctctcatgacaaaaagagaggagcacatgattcttaagacttggaatgagacaagccgtgaatatccggatgcctgcttccatgaattattcgaacgtcaggcggcagaaacgccggacgcttgtgcggtcgtgtatgaacagcaaaagctgacgtaccgtgagcttgatgaaaaaagcacgaagctggcgctctatttgcaggcgcacggtgcaggccctgatgatctcatcggcatttatacagaccgttcattgcatatggctgtcggccttctcggcattttaaaagccgggggagcgtatgtgccgcttgatccttcttatcccgctgacagattggaatatatgatcgccgacagcaggatttcaatgtgtctgacgacagctgatttagagcactccttgaactggggaggcgtgcagacaactgccattgaccgcgattggtctcgtattgaaagtacagccgcggaaagaacgtcgctgaagcggttagtgacacctgacgatctggcgtacgtcatttacacgtcgggcagcacgggcaaaccgaagggcgtgatgattccgcaccgggcgctgaccaatttcttaatctcgatggcgaatgaaccggggcttacgtccgaagacaaactgcttgccgtcacgacatattgctttgatatcgcggcactggagctttacctccctttaatcaaaggagcagagtgcaacatctgtaagacagaattcacaaaagacgcacggaagctgaaagagctgattcaagagtacaaaccgacgatcatgcaggcgacgccgtttacgtggaaaatgctctttcattccggatggtcaaatgaagaaaaagtgaaaatcctttgcggcggagaggcgcttagcgaacaattgaagcagcagtttctcgatacgaaaagtgaggcttggaatatgttcgggccgacagagacgacaatctggtccgcggtgcagcgtataacggaaaatgagagcgcgcttacgatcgggcgcccgatcgccaatacccgtgtgtatattatggattccgctctcaaccctgttttagaagggatgccgggagaactttgtattgcgggagacggattggcaagagggtatttcaacaagcctgagctgacagataacgttttcgtcagccaccggctcgaattgggatcaaagctttataaaacaggcgatatggcgcgttttcttcccggcggccgcattgaatacatgggacggatggacacccaagtcaaaatccgcggctaccggattgaacccggagatattgagagccggctgaatgcctatccggccgtacaggaaagcgtagtggttgtgaacaatcactccggaaatgaaaaactttgcgcattttatatcctgaaaaacggagagccgcttccgtctgcaaaggaattgcgcaatcatttgaaacaagcgctgccggcctatatgacgccagcttcgtttatccgtcttgaagagctgccgctcacaccgaacggaaaagttgaccgcaagcttcttgctgcccgcgatctgacggaaaagcagccggacacacaaacattttcatcatctcatatccagcaggcggtgctggcgatttggcaggatgtattgaaaagcaaagatatagagcttgatgaccgcttttttgatgcggggggagattcgcttcttgccgtgactgtcactgaccggatgacgcaggaactggattgtgaattcagtgtaacggagctgtttgaatacgcgacggtaaaagacatcagccggtacatcacagaacaaaaactgaaagaaaccgttttggctcctgtgccgcaaaagaaagtgaatacagaagaccgggaacacccagcgggagaaattcccgattattatgaggacagtgtcgcggttatcggtatatcctgtgagtttccgggagcaaaagatcattatgaattttggaataacatcaaagaaggcaaagaaagcatcaacttcttttcaaaagaggagctccgccgatccggtgtttctgaagaactggctgatcatcccggcttcgttccggctaaatcagttttagaggggaaagaaatgtttgatcccggtttcttcggcttttcaccgaaagatgcggaatatatggaccctcagctgagaatgcttttgctccattcatggaaggcaatcgaggatgcgggatatatctcaaaagaaattccggaaacaagcgtgtatatgtctgcaagcacgaactcttaccgcagcctgctgccggaggagacgacagcacagctggaaacgccggatggctacgtatcatgggtgcttgcccaaagcggcacgattccgacgatgatttctcataaactcgggttgaaagggccgagctattttgtccatgccaactgctcatcttcgttaatcggcctgcattcggcttttcaaagcctgcattccggcgaagccaagtatgcccttgtcggcggtgcgacccttcatacggaatcaagtgccggatatgttcatcagccggggctgaatttttcaagcgacgggcatattaaagcgtttgacgcggctgctgatggaatgatcggcggtgaaggagccggcgccgtgctcttgaaaaaagcgtcggatgccgttaaggacggcgaccatatttatgcgctgctgcgcggaatcggcgtcaataacgacggagcggataaggtcggattttatgcgccgagcgtcaaaggacaggctgaggtcattcagaaggtcattgatcagaccggcatccatcctgaaacgatcgcgtacgtcgaagctcacggcacaggaacaaaactcggcgacccgatcgaactgtccgcacttcaatcggtgtacggccgatatacagataaaaaacaatactgcggcatcggttcagtcaaaacaaatctcgggcatttggatacagcggccggaatggcgggctgcatcaaggttgtcatgagcttatatcatcaggaaatcgcgccgagcatcaattacaaagagccgaacccgaatcttcatttagaagactctccgttttacgtagcgggagaaaagaaagagttaacccgtgagaacagagcgcaccgcatggctttaagctctttcggtcttggcggaacaaacacacacgcgatttttgaacaatatccggatgcatccgaagcagcagacgctgccggtccgttcatcattccgttgtctgccagaaaaaaagatcgtctgaaggagtacgcaaaacagctgctggcttttctggaaagaaaaacggacgccggcctcgctgatcttgcctacacgttccaagtcggaagggaagcgatggaagagcgcgcggcctttatcacaagcggcactgcggagctcaagcggcagcttgccgattttatcaatgataagccggctgtaacaggctgctttagaggagaaaaacagcaggcaaaagatattgcctggctttctgatgatgatgacagcgctgaactcattgagaaatggcttgcgaaaggaaaaggaacgaagctctgtgaaatgtggagtaaaggtgtcgccattaattggcacaagctttacaaagacaagcatccgaaacggatcagcgtgccggtctacccgtttgcaaaggagccgtactggccgaaaaaagcagaaaagaaaacatctgccgcacacaccggagtctcagttttacacccgcttgtgcagcaaaatacgtcagatttggccgttcagcggttcagctcacggtttacaggctcagaatttttcctgaaggatcatgtggtcagggaaaaagcggtgctgccgggagcggcatatttggaaatgtcttatgaagcggtaaaacgggcgcttggcggcttattaaaagaccaagacagaataacgctccatcataccgtctggatgaaaccgatcgtcgttcacgaacaagagcgccaagtccatatcgcgctgtttcctgaagaggacggcatcatctcatatgacatttacagcgtaaacgctgacgatgaagaagtgctgcacagccaaggacgggctgaaatcataaaggctgaacgagagcctgaggccgacctttctgccatacaaaacagatgcacagcggacattcttgatccggcggccttttatcgggaaggccggagcagggggatgttccacggaaaagccttccaaggcattaagtccgcctttatcggcgagaaagaagtgctttcggatatacagcttccggattctgtttctcatacgaacggacaatttacgcttcatccgagcatcattgattcggctattcagacggcgacgatctgcattatgcaggagttttccggacaaaagctgattctgccgtttgcgctggaataccttgaagtcatcaaaccatgcacaccgactatgcgggcgcatgcacgcttcagcgaaggatatcaaaccggtgattccgtgcagaaagccgacattgacctgttcgacgaaacaggagcgctttgcgtgaaggtgagaggattctctacgagagtgcttgaaggcgatgcagaatcggctcagcggccatcaggctcggaaaaggtcttgtttgcaccggtttggaaagaagccgccgcatccgagaaagcttctgtccatgctgatgagcatttgatcatactttgtgaagatgcctgccgtataaaagatgaagcggcatccggcctgaaagacgccgagctgctgattgcagaaggtgagggagaaacagccgctgaacgcttccaaggctacgcgcagacaatcgccgaacacatccggcggatcatcagcgaaaaaaggcagggccgcattctgattcagactgttatttcagcagacggcagccagcaattgtttgcggggttaacaggtttgttaaaaacagccgagctggaatacggaaaacttgactgtcagctcatcgagatggaatcaatcggcgaaatgccggctgccgctcaaaaactgaaaaacgacagccatcggccgcatgataaacatatccgttatacaggagaaaaacggtatgtgaaggcttgggaagaaatgcatcctgcaggtggcggcgccgtctggaaggacgaaggcgtatatctgattaccggaggcgcaggaagcctggggttgatgttcgcaaaagaaatcgctggtcgcgtaaaacacccgaaaatcattctgaccggccgctcaaatctggcagaagccaaacagcgtgagcttgctatgcttcaggactcaggcgcaaatgtcgtctacaaaaagctgaatgcggcagaccggcgggaaaatgaagcgctgataaaagagattacggcggaattcggggagcttaacggaattattcacgcagcgggcgtgatacaagaccgtttcctgctgcaaaaaacgaaggaagagttctgggaagtgcttgatccgaaagtgatcggcaccgcttatttagatgaagccagcaaagactgcaaccttgactttttcgtattgttctccagtgtttccggcgttctcggcaatgtcgggcaggctgattatgccgccggcaacgcgtttatggatgcatacgccgcttacaggcaatcccttacggagaatggcctgcggcacggaaaaacgatcgcctttaactggacgctgtggaaagatggcggtatgcaggcgggagacgagacggaaagaatgatgaaaaaagctttcggcatggttccgcttcaaaaggcgtcaggcctggctgcattttatgaaggaatggctcaggaaaagccgcagcttttagcagctgaaggacacgcagcaaaattaaaacagtcgttcctgtccgtttctgaaactgaaaagccgcaggtggagaaaatagaacctgtatccgccgtttcgggagacaaatggcacggtgcgcttatcagattggtcagttcaattttaaaagtcggccaagacgagattgatattgatacggaactgagtgaatacggttttgattccgtatcctttaccgtctttacgaatcaattaaatgaagcgtatcagctggagctggcaccgacgatcttcttcgagcacgggacgatccgcagtttagcagagtatttgtcggatgaaacagagagaggtcttccttttcagccggaagaaaaacacgatgcagaagaatctcttcaagcgcttcacaccgctttgacagccatggtaagcagcattttaaaagttgaccgtgaggacattgatacagatacggaactgagtgaatacggttttgattccgtatcctttaccgtctttacgaatcaattaaatgaagcgtatcagctggagctggcgccgacgattttctttgagtacggaacgatcagtaatctcgccggatatttggcaaaagagcatccgggccgtttcggcgaaaagaagaaggagtctccgaaaaaagagcagccaaaagcccaaaaaccgaaaacgcatcggaaaaagcgtttcgcaacggtgatgaacgctagggcagcgacacaagagccgcgccgcttgaacccggttgccattgtcggaatcagcggccgattcccgggcgcgaaggatatagaggaattttggcgcaatctgaaagaaggaaaagattctatcacaaccattccgaaagaacgctgggattggcaagcgtttgatggcgacccgaatcttgaaaggaacaaaacgaatattaagtggggcggctttatcgacggaatagctgaatttgatccgctgttctttgggatttcaccgcgggaagcccaatatttagatccgcagcagcggctgttattgacttatgcatggcgggcgatagaagatgcgggctgtaagccggaaagcctttccggcacaaatacgggtgtctttatcggcaccggaaataccggttataaagatttgttcacaagggcaggtcttgcgccggaaggacatgcggcgacaggcagcatgattccttccatcggtccgaaccgtttaagctatttgttaaatcttcacgggccgagcgagccggttgaaacggcatgttcaagctcgcttgttgcgattcaccgggcggtatccgctatagaaaacggagaatgcgacatggcgatcgccgggggaatcaacacgattctgacggaagaagcgcatatcagctacagcaaagcaggcatgctcagcaaagacggaaaatgcaaaaccttctccaaagatgccaacgggtatgtcaggggagaaggcgcgggaattctgatgctgaagaaactgacagatgcagaacgtgacggcaatccgatttacggcgtgatccgcggtacggctgaaaaccacggcggccgggcgaatacgttaacctcgccgaatccgaaactgcaggctgatttattggtgaaagcatatcggaaagcgggagtggacccgagcaccgtcacgtatattgaagcgcacggtacaggaacggaattgggcgacccgattgaaataaacggtttgaaagcggcgtttcacgagctggcgaaaacaaatcaagagcctgaagtctccgatcaccgctgcggcatcggttcggtcaagagcaatatcggccatttagagcttgccgcgggagtatcaggcgtcatgaaagtgcttttgcaaatgaagcacaaaacgctggtgaaaagcctgcattgcgagacgatcaatccgtacattcagctcgatgacagtcctttctacatcgtgcgggaaaatcaggaatggacggcagcgaaagatagaaacggaaatgccattccgcgccgggccggggtcagctcatttggcatcggcggggtcaacgcccatatcgtcattgaagagtatgtcccgaaagcagccgctctgcctgagcacagcccggaaaatccggcaatcatccttttgtccgccaaatcaaaagaaaaactgttcgaacaggcgcagcagctgcaaaaagcgatccgtcaaacgccgtatacagatcaagacttggcgggcgtcgcttatacgctgcaaaccggaagggacgaaatggaagagcgcctggccattcttgcagcgacgatggcggaattggaaacaaagctggaagcatttacgaaaaatgagaaaaacatcgccgggctgtataccggccagtctcaccgcaataaagatacgtttgccttgttcacggcagatgaagatatggacatcgtcattgacgcctggattaaaaaaggaaaattcgccaagctggcagaggtatgggtgaaaggcggcgtgttgaattggaaccggctgtatgaaaagggtacgccgcgtttactcagtcttccgtcttatccgttcgcaaaagacacgtattgggtgcctgagaatcctgacaaaaataaggtccatacagaggaacggatgaaacgtattctgacaaaacaatgggaaccgagcccgctcgaactgcgtgaaccgtgcccacgttccgttgcgattttgacaggcggggacacgatcaatctcgcagaagagatcgcagcgcatatgccgaatcaccgtattatcacaacatcagaccttacaggtgaatatgactggcaggcgtttggcggagtcatcgaccttctcggtgcagcgaaagaagaagcttctggagatatgaccggtatcaaatggcttcagcaattgattgagcatgggcataaagaagggataacactgctttgtgtcacgaaagaccttgagtcaatggggaaaaaggccaatcaaataacgggagcaaaacgggccgggctgtacagaatgctggcatgcgagtacagtcatctgtcttcaaggcatctcgatcttgaaggagcgctttcggatgacaaactggcgaagcagattgccgatgagtttcatgcccgtactgatgacgcggaagtttgccggagggacggcttgcgctaccgcgccgtattgagcggttcagaaaatatgaatacgcaaggcgagagaattgattttccggaccaccatgtgcttctgatcaccggagggacgagagggatcggtcttttatgcgcacgccattttgccgaacattacggagtgaaaaaactggtgcttacaggccgtgagacccttccgccgcgaagtgagtggacgggcggactgaatggggtgacggcttctgtaaaagcgaaaattgaagctgttctcgacttggagtccaaaggtgtacaagtgaaggtattgtcagtcccgttagctgatgaagccgggctgagacaggaattgagtcagatcaaacagacgctcggacctatcggcggcgtgattcactgcgcgggtgtgaccgataaagagacgctcgcattcatcagaaaaaccgatgaagacatacagcgcgtgctcgagccgaaagtagaggggcttcaggcgttatacagtgtgctcagcgaagagccgctgaagtttttcgtcttgttctcttctgtgtcagctgcgataccggcgctttcggcaggacaggccgactatgccatggccaatgcgtatatggactattttgcagactcatacaaagagcagctgccgatcgtaagcattcagtggccgaactggaaagaaaccggaatgggcgaagtaacgaacaaagcttataaagagagcgggctatacagcatcacgaatgcagaaggattacagctccttgacggcatacttcttgaatcagcaaggggcccggtgctgccggccgttctgaatcctaagctgtggaagccggagcgattcctgcggcggagcaggcaggatcagccaatgagcccggctatggtaaaatcggcggaaaaaaccgctgataccgccgcagacaacgctcaattaacaaggaaaacagaagaatggctgaaagaattattttctgaagagctgcggattgaccaggatcagcttgagacagacgtattattccaagattacggagtggactccattatccttgctcagcttctgcagcggatcaatcggaatctctcggcatcgcttgacccgtccattctgtatgaatatccgacgattcaatctttcgcaaaatggcttctcgaagggtatacagaagttttgtcagaacggtttgatttggcggcggctgagcctgttatgaagaagccggctgagccggtaattgtaacacaagccgttaaggtgcaagaagaggcggccgaaaaacagattcaccgggaagatatcgcggtcgtcggcatgtcctgccggtttccgggggcggcttccttagaggcgtactggtcgcttttggctgaaggccgttcggctatcggtcctgttccggctgagcgatggggggtgaagacgccttattacgcgggaatgcttgatggaattcatcaatttgatccggacttctttttactggctgaagaagatgtaaaggcaatggaccctcaagctttggccgctctggaagaatgtcttaacctgtggtatcacgcgggctatacgccggatgagataaagggagaagcaataggtgtgtacctcgggggacgcagccgtcacagaccgggtgaagagaaactgctggatgcgaaaaacccgatcgtcgcgctgggccagaattatttggccgccaatctctctcaatattttgatatgcgcggcccgagtgttgtcctcgatacggcttgttcttctgctttagtcggaatgaatatggccgtgcaggctcttgtaacaggagaaataaaagcggccgtcgtcggcggtgtgagcctgtttgaatcagaagaaacccataaattatttgaacagcgcggcatattaagtaaagcgcagtcgttccatgtatttgacgaacgcgccgatggagtcgtgctgggcgagggtgtcggaatggttcttttaaaaaccgtgtctcaggccattgcagacggagattctatttatgccgtagtgaaggcggcatccgtcaataatgacggaagaacggcaggcccggctacgccgagtctggaagcgcaaaaatccgtcatgaagacggctcttgaaaaaagcggaaaacagccggaagacattactcatattgaagcgaacggttcaggcacggtcgtgacggatctgttagaactgaaggccattcaatccgtctaccgttcaaaagacgccggcccgctcggaatcggatctgtgaaaccgaacatcgggcacccgctttgcgcggaaggaattgcaagtttcataaaggttgttctcatgctgaaagaaaagagctttatcccgtttttatcaggtgagcatgaaaacacacattttgatagagaaaaggccaatattcagttcagccgcactctggcagactggccgtcaccaatgccggcggcaggaattaactgctttgccgacggtggaacaaatgcccacgtcattgtggaagcgtggcagggagacgaagggcgccgaatcaagcgccaccctttaacaccgcctgcattaaataagcggctgatttcgccggacagcaaagaagaaacgaacgaaaaagctgcggcaaacatctgggatacctatgaagtggaggtttaacgtgaagaacttcaataagcaaatcactttatcgctgaaaaatccgtttattttacatcatgacgtttacggacaaaaagtccttccgggattggcttatattgatatgttttatcagatttttaaagagcgcggctattcatacgacgggcttcagctgcgccatttatccatatatcagccgcttatcgcgaaagaagacagcgccgtcaagcttacggttgaatgtacaaaggtaaaagaagggcgctggaaacttaccgcaaaaggggctgaggtcagcggcggacgagtccagccggaagaacgtatttacgtcaaagcggaaatgcacgagacggcacccgcagttttcagtgacacgcttgatcttgactctgtcaaacgcgaggcggaacgcaccatcgatttaaatgagctgtatgcccaatgcagaagccaggaattggttcacagcggatatatgaaagcggaaggagaagtgtttgaggagcgggacggcgtcacctttgatgtatcgctcggaaaagacgcgatgggacaggccgaagggtttttgttccatccgactcttcttgacggaagcggcgtcggcgcaaacctattgatctcctcgctgttaaatggggaaaagaggctgtttctgcctcttttctacgaatcttttacagcttccgaacctttgcaggccggctgcatcacgagaatcaaacgttcgtcgcttcggcaggaaaaagagctcatttacattacactggagttttttaacacatccggccgaaaagtagccgagctgaaagatttcacaagcaagctcgtgcgggatgccgagctgatcaatacagaccgaaagactgctgagaagcctcctgaaaaagtcggtttaccggaagttgcggcatcgcttgaaggcggacacccgcatgaggaagcagaacggtatgtcatgaatctgatggctgaaaaaatcggcaagccgcttgaacagattgattctcaagtcggctactatgaaatggggctgacatcgtccggactgcttgacgtcgtcgaaacgatcagtgaaaaaatcggcgaaaccctttctccgactttgctgtttgaatatacgacggcatcagagctggcggctttcctgacagagcagtacggaagccatttcagcgcgtctcctgcaaaaatagagaagcaggttgagaagcaaacagaaagaagacggaaaagcagtgttccgcaagatgaagatatcgcgattatcggcatggccggccgctatccgcaggccgaaaatattcatgaattctgggaaaacctgaaagaaggaaaaaactgtgtcaccgaaattccggagtctcgctgggactggcgccggtttgaaaatgtaaagtcgccttccggaaagagcatttcaaaatggggcggatttattgatgatccggattgctttgatccccaatttttccggattacgccgcgggaagctgaaacaatggaccctcaggaacggctgtttttacaaacatgctgggaaacgattgaggatgccggatatacgccgaagtcgctcgcagaggcgcgcggacggaataagaggcagcgcgtcggtgtcttcgcaggggtgatgcataaggattatacgttggtcggggctgaagcttcttctgaagatcatgtattcccgctttctcttaattatgcgcaaatcgcaaacagagtttcatatttttgcaattttcacgggccgagcatggctgtcgatacggtctgttcatcctcgctgactgcggttcaccttgctgcggaaagcattcggcgcggggaatgtgaatcggcggttgccggaggggtcaacttgtcgctgcatccgaataaatatctgacatacggtttatgggacatgttttcaacagacggggtttgtcatacattcgggaaagacggagacggctatgtaccggctgaaggaatcggtgccgttttattaaaaccgctgcgagaggcggtaaaagacggagaccggatttatgcggtgataaagggcagtgccgtcaaccacgtggggacagtgagcggaatttccgtgccgagtcctgtcgcgcaggccgatttgattgaagaatgcctggacaaagcgggcatcgatccgcgcacggtcagttatattgaggcgcacgggacgggaacttctctcggcgatccgattgaggttcaaggccttgtcaaggcgttccgccagtacacacaggacaaacagttctgttcgatcggatcagtgaagtccaatatcggccatgcggaatcggcggcgggcatcagcggcttaagcaaggttgccctgcagcttcaccataaaactttggtgccgtctcttcattccgaggagctgaatccgtatttagattttgaacaatcaccgttttacgtccagcatcataccgaagcatggcagcagccatcagtgacggaaaacggaaacgagaccgtatatccccggcgtgcgggcatcagttctttcggggcgacaggttcaaacgtgcatctcattctggaggaatttatccctgaagaatcacggagaacagcgtatgaaccggcagaagaacagactttcattttcccggtttccgcccggaatgaagaacggctaaaagagtatgttgcgaagctgtcttcatttatttatcccggcctgccgcttgaggatgcggcgtatacacttcagatcggccgtgaacagatggaggagcgggttgcgttcaccgctcagaatatgacacagctcaaagagcggctggaaggctttctggcgggtaaaacggtcagcggatgctggcggaaccgagccgataaaagcaatcaggcagagcttgctccggacttgatacataaatggctttcttccgggagtctggagatgattgccgaaaagtggaccggcggaggaacgatggattggaatctcttgtacggtgaaaacaaaccgaatcggatcagcctgccgacatatccgtttgaaaaaatccggtattgggtgccgaaggcggagaaaagagaatcgctgccgcaaaaaagggcaggcatgctgcatccgctccttcatgaaaatgtatcaaacatgtcaggtgttcgtttccggtcctcttttagcggcggagaatttttcctgaaagatcacgtcgtcaaaaacgagcggacgttaccgggcgcggcttatctggaaatggtccgggcggccgttgaacacgcggcagaaacgaaggaagaaggaacagtccgtctgaaaaacgtcgtatggatacgtccgtttacagcggcggatgaatccgcagaactgtatctccgtctttatgatgaagaaaatggggagatgggcttcacggtttacggtgaatcggcttcctcggaacaagagcccgttctctatgcgcaaggaagcgcggcgtttgtccgagggggcgaaccggccaaaatcgagattgacaaattaagagagtcacgccgtctgatcacacctgacgcttgctatcaggcatacaaacagatggggattgaatacggggatgctcacaaagcggtcacggaaatctatgcaaaagacagcaaagtgctcgcgaagctctcactcccgtcatctatttctcatacaaaagatcagtttgtcctccatccgagccttttggatgcggctttccacgcgacaatcgggttaatgcttgacagagacggaaatgacataaggccgatgctgccgtttgctctcgaacagattgatgtgttgaaaagctgtaaaagcgatatgtgggtttccattgcgtacagcggcgaaagcaagccagaagatgccgtgcagaagctggatattgatgtatgtgacgaacaaggcaatgtatgtgtgaaaatgactggttattccgcacgggaaattgaaacggataaaacagatacactattttttgaacacgtatgggaagagaaggccgctgtacatgaaaaagcgccgactcatttcaaagcccgtcacgtgatgatatcagaccggtttacggatcaaatgaacagcatacagacagacttcagctgtcacgtgctccgtgatcagcataagagtgaagacgaacggtttgaagcttgtgcgcttcaggcgttcgaagaagtgaagaaaattctcgcttcaaattccggcgggcgcgagctcattcagattgtcgtgcctcaagaagcggatacgcagctcctttgcggcttaacggggcttttgaaaacagcggcgcttgaaaacccgaacctgaccggccagctgattgaattggagccggacgtcaaggcagacacgctgtcccgatatgtaaaagaatgcagcgctcatcctgatgacaaacatattcgctatgaaaacggcaagcgctatacggcacaatggcaggaaacagggcttgaacagttcggcgccgaaaagccgtggaaggataaaggtgtttatctgatcacaggcggtgcgggcggactcggatttttattcgccaaagaaatcgcccgacatgcaaaagacgccgtgcttattttaacggggcgttctctgttggataaccgtaaaaaagaccagctgcaagaactgtccgatctcggcgcgcaagccgtgtacaaacaaacggacatgacggaaaaacaagaagttcaatcgctcacagcggacatctgccgacagtacggcggattaaacggtatcatacacagcgcgggaacgataaaagacaattatattctgaaaaagcacaaaggtgaaatccgtgatgtgctggcgccgaaagtctccggactggttcatcttgatgaagcggcaaaggacattgagcttgattttctgattcttttctcttccggagccggaagcgccggaagcgcgggccaggctgattatgcgatggccaatgcgttcatgaacgccttcagtgaaaaaagaaaccgtaaaaaagcccgaaatgaacgctatggacacaccctttcaatctgctggccgctttggaaagacggcggcatgacggttgatgctgaaacggaagcgatgctgacaaaagaaagcggcatggtccctatgaaaacagaaaacggcatccatgctttgtaccgcgggtgggcggcaaacacatcccaaatcatggtgacggaaggctacgccgcaaaaatccgggcgtttctgaaaaaatcagcggatgatcagccggataagggcagcgaaacggaagaaccggcaggtcttacggcaggcggagagaacatgcttgcagaaaaaacggagcatttcttgaaacatgtgctttcggaagtaacaaaacttcctgtcggcaaaattgacgccaaggcgcctatggaagattacggaattgattcgattatgattatgcatttgacgggccggctggaaaagagcttcggttcattgtcaaaaacattgtttttcgaatatcagaatatcgaatcgctggcgcagtattttatgaaagcacaccgggacacgctgctggaagtgaccgggctgaaaacagaagaaacctctgcagccaaaccggcgctgtctgaaaaagccgaaataaagcccgtttccaaacggaatgaagccaaaaaaggctttgcgcaagtccgcacagacacgcggaaaaatccagtgacggagcgtgaagatatcgcgattatcggtatatcaggacgatatccgcaagccgaaaatcttcaggaattttggaagaacttgagtgaaggcactgactgcataactgaaattccaaacgatcgctgggatcacagtctttattacgacgctgataaagataaagaaggcaagacgtacggaaaatggggaggatttttgaaagacgtggacaaatttgatccgcaattcttctctatttcgcctcgggatgcaaaattgatggacccgcaggagcggttattcctgcaatgtgtctacgaaacgatggaagatgccggttacacgcgcaaaaagctcacggaaaaatcgggtgatttgcttggcgccaatgtcggtgtttacgtaggcgtcatgtatgaggaatatcagctttacggagccgaagaacaggcgcgcggaaaatcgcttgcgctgaccggaaatccgtcatcaattgcgaacagggcttcctatgtattcggttttaacggtccgagcatggcgctggatacgatgtgctcttcttctttaacagccattcatctggcatgccaaagcttgcggaacggggaatgcgagacagcatttgccgggggcgtcaatgtatccgttcatccgaataaatatttgatgctcggccagaacagatttttatcaagcaaaggcagatgtgaaagtttcggtgaaggcggggacggttatgtgcccggtgaaggagtgggagcggtactccttaagccgctttctaaagcgaaagcggacggtgatcatatttacggcctgatcaaaggaacggccgtaaaccatgatggaaaaacaaacgggtattccgtaccgaatccgaacgcccaagccgcggtgatcaaacaggcgttaaaagacgcgggaaccgatccgagggcagtcagctacatcgaagcccacggcaccgggacttcactcggtgatccgattgaaatcacgggtctgacaaaagccttttcagaacaaacacaagataaacagttttgtgccatcggctcagcaaaatccaatatcgggcactgtgaaagcgcggcgggcatcgcgggtctgacgaaggtgctcctgcaaatgaaacataagaagctcgcaccgtcactgcattcccggacgcttaacccgaatattgattttctcgctacgccgtttatagtgcagcagacgcttgaagagtggaaaagaccggtcataaatgaaaacggaataaataaagaactgccgagaaccgcggggctttcctcattcggagccgggggcgtcaacgctcatatcgtcatcgaagaatataccgctgatgaggataaggagacggcttttgccgctcctcatccatcgatgatcgtcctttccgcgaaaaatgaacaaaggcttcaaaaacgggcggaacgtcttcttgatgcgctgcggagcgggcgttaccaagaagcggatctgagccggatcgcatatacgcttcaaatcggacgtgaaccgatggaagagcgtctcggaatgattgtcagcaatttgcgcgagcttgaagaaaagcttgacgaatttacgggcggcaaggagtcaattgaccggctctaccgcggacaagtcaaacagaataaagacacgatggcgctgtttgcggctgatgaggacatggaaaaaaccattgaggcatggcttgaaaaaggcaaagccgcaaaggtattagagctttgggtgaagggccttccgctgaattgggataagctgtatcaaatgggcagaccgcaaaaaatcagtctcccggcctacccgtttgcaaaagaccgttattggatcgacacatcagctgatgcagctgtcaaaagaccggccgaaacacagtctgcgccgatcgcaccggcggccgtcccggaaccggtcattgaagtagcaactcttcacgaggagactgccaaagaaaaaccgtcaaacatttcattgcagcctttgagcggcgcgaaaccgaaaagaaccgtacagtctgcttcccgtccggcggtatccgctgaaaaagtaagtgccgaattaacggaaaggttggcggacgtgttatatatggatgccgacgatatcgacgcagatgacacatttattgatatcggcatggattcaatcacaggtcttgaatggataaaggccgttaataaagcgtacggcacgtcccttacggtgacgaaagtatatgattatccgacaatccgccagtttgcggccttcttgcaaaaagaactcgggacagaaccgatccttgaggaagcagccgaaccgcagaaaacagaggccgtaaaaaaaccgtcaaacatactgctgcagcctttaaacgctcataagcagcatgtgatacaagcagaagcggatattctggaggcgatgtctgaaacggcagcttccgccgaaccggaagaaccgattgaagcggtgcatgacgagttatcaaaagcactggctgatgtattgtacatggagcggcatgaagtggatattgatgaggcctttattgacctcggtatggattcgattaccggtcttgaatggataaaggccgtcaataaacggtacggcacggactgtaacgtaacgaaagtgtatgattatccgacaatccgtcaatttgccgattttctgcgtacgcagccgtccgtccgcggcagaaaaaaacaggcggttcccgtacgtccaaagccgcttacacagcaagccgccccgcaggagaaaacacctgccgagccggagagattaacggttcaaaaggaacctgaaccggtgcaggccaaacgggagcctaaagacgagatagcggacgcgatagccatagttggcatgtcgggcaagtacccggatgcgccggacctaaaggcatattgggacaacttagcccgtgcgaaaaacgctatccgcgacatcccgctttcccgctgggatgtaaacaaatactatgatccggccttaaacaagaagggcaaagtatactgcagatcaatcggtatgcttgacggcattgaagagtttgatccgctgttctttaatatttctccgtctgaagcggaacttatggacccgcagcaccggatatttttacaggaaggttttaaagcctttgaagatgcgggttacagctcaaaagaattaaacggaaaaaattgcggcgtttatttggggattatgaacaatgaatacggaatgatgttaaacaaacatcagacaggaggaagcgcgacgggcaacagtttcagcatcgcggcggcccgcctgccttattatctcaatttgaaagggccggccattccgatcgatacggcatgctcttcatctctcgtcgggactcatttggcgcgtcaggcgctgttgaatcatgaaattgacatggcccttgtcggcggcgtcaccttgtatttaacgcctgaatcatacatcagcatgtgtgaagccggaatgctgtctcctgacggccaatgtaaagcatttgataacagtgcgaacggatttgtgcctggcgaaggcgcgggggcgctcgttttgaagaggctgaaagatgcggaagccgatcaagaccatatttacggagtcattatcggatctggaattaaccaagacggaaaaaccaacggcattaccgcaccaagcgcgaaaagccaaatggatttagagcgtcaagtgtatgaagcgcacaacatccaccctgagagcatcacctatgcggaaatgcacggcaccggcacaaagcaggggatccgattgaattagaagccttatcttctgtattcaaggaaaaaacggaccgcaaacaattttgcgccatcggttcggttaaatcgaatatcgggcatacgtcggcggcggcaggtgtagcaagcgtacagaaggttctgctgtcgatgaagcaccagcagcttgtgccgacccttcatttcagcacgccgaatgaacattttgatttcgatgactcgcctttatttgtcaataccgaacttaaaccttgggaaacaggcggagcaccgcggcgggcctgcgtcagctcattcggctacagcggcacaaacgctcatctcgttatcgaagagtatcagccgaaagaccggggaagccgcaagtctgatgagacaaacatttttgtgctgtcggcgaaaaaagcgccgcaggtaaaaacctatgctgagtctgtgatcgaatttgcaaaagccaatcagaatatcaatctttcggatatggcatacacgcttcagaccgggcgtgatgcgatggattaccgtcttgcggttacagccggttcgagagaagaactgatcagccgtttaaccgattttgtaaacggaaatacgggtgaagggatatatgaagcccacatcaaaacggcaaaaaaagaaatcaaagcatttgaaacggacgatgatctgaagcagcttgtcaggtcgtggttcgataagaaaaaatacgccaaaatagcggaattgtgggccaaagggcttcagacggactgggacagactctatcaaggcgaaaaaccccgcagaatcagtctgccggcttacccatttgcgaaggagccgtactggctgcctgagccgaaagccgtaccgcaggaaacagaagaccggcgcaaggctgtgcttttagaaaagcaatgggttccgtgtgagatcgattcggccggtgagaaaagcggcaggacggtcatgattctggctgatgcaagaacagcggaacttgccgaagagactgcgaagcatttcgctgactcgttcattctcccggccgctgacactgcagctagcgattggaatcacatagatggcgtaatcgatctgacgggatgcggagacgaagacccttcactggaagggatcagccggctccagactctgattgatacaagccgccggcaagcgcggccgctgacgctgctatatgtaacaaaaggcttggagccatttcagcagaaaacgattcatcttgcaggagcggcaaaaagcggcctgtacagaatgcttcaaaatgagtatcaaaacgtgacgtccagacacatggataccgatacagatacggatcagcagacgcttgccaaacagattgcagatgaattttcggcggacagcacagaaccggaagtctgccgccgaaacggacaaagataccgtgctttgttcagcgagattccaagcgggaagcgagcagaacataagccagcaccgtttcctgaagaccatgtgcttttcattaccggagggacgaggggactgggtctcttatgcgcccgccatttcacagaaaaacacggcgtgaaaaaagtagtgctgacaggcagggagccgattcctccccgtcataaacggacagccgttaatatgaggctgagagagaagatacgggcgattgaagagcttgaagcaaaaggagtgcaagtggcggtgatcagtctgaaattgtctgatcatgacgcggcggcagcggaaattgaaacgatccggcgcacgatgggaccgatcggcggcgtcattcactgtgcgggatcggttaattcagtaaatccggcgtttatcagaaagactgccgacgacatacaagaagtgcttgaaccgaaagtcgccgggcttcaaacattaagcagccttttcacaaatgatcctttgcaattttttgtcttattttcttcagtatctgcagtcgttccggcactcgcggcgggacagtcggattatgcgatggcaaatgcgtacatggattatttcgcggcggctcatcagcatcaatatccgttagtcagcattcaatggccgaactggaaggaaaccggattgggtgaaatccgcacagaaaacctgaagcagaccgggctgctgggactgtccaacgcggaaggacttgacttgctggaccgcattttatctgaaaacatccgcccgtccgttctgccggctatcgttgatcggagcgaatggcatcccgacaggctgctctgtcaagagaaaaaacaaaaagagactgaagccgtaataaacggcaaagacgcggaaaaacattcagacagagaactgcttcttgatacgaaggcatggcttgtgaaactgttttccgatgagctgaaaatcgctccggaagatctggaaacagacgaaccgtttcaggattacggggttgattcgatcattttagcgcagcttttacagcaaatgaatcaagcgctcaaagaggacttagatccgtctgttttatatgaacatccgacgattgacgcgtttgccgaatggcttgtatccaatgggcagccgctgcttgcagaaagggaggaacctgatacggaaatgttggttccggctgccgtacaaacggttcacactgagcaaaagcgtgctgctgtaactgaagacattgccgtcgtcggaatgagctgccgttttccgggagcggaatcgttagaacaatattgggacttgctgagaagcggcaggtccgcaatcggctccgtcccggcggaacgtttcggatatgcaaatcaatatgttgcgggattgattgacaatatggatcactttgattccgaattctttttcattccggaaaacgacgcgaaagcgatggaccctcaggcgttggcggtgctggaagagagcttgaaactttggtgccatgccggctatacccgtgaagaaatcaagggcatagaagccggtgtgtatatcggaggccgcagccagcatcagcctgatcctgaaagtcttgcgaatacccgcaacccgattgttgcgggcgggcagaattatttagcggcaaacgtttcgcaattttttgatctgcgcgggccgagtatcgtgcttgatacggcttgttcatcagctttgacaggaatgaacatggccgttcaggcactgagaagcggcgatatcaaagcggcggtagttggcggcgtcagcctgctgaacacggatgcggcgcaccggatgttccaagagcgcgggctgttaaacgagaaaccggcatttcacgtatttgacaagcgttcaggcggagtggtcctcggtgaaggcgtcggcatggtgctgttaaaaacagtaagccaggcgcaaaaagacggcgatacgatacacgcggtcattaaggctgccgccatgaacaatgacggcagaacggcaggcccgtcagccccgaatatgcaggcgcaaaaagacgttatgcaaagcgcgcttctcaaaagcggcaaaaagccggaagacatcacttatatcgaagcaaacggatcgggttccgcggtgactgatttgcttgagctgaaggcgattcaatccgtataccgctcaggtcagcatgttccgctcggcatcgggtcaatcaagccgaacatcgggcatccgctttgcgcagaaggcattgcaagcttcattaaagtcgtattaatgctgaagcataaacaaacggttccgtttctctcaggagacgaaccgatgccgcattttgatataacaaagacagattttcactttcataaaacagccggcgaatgggatgcagccagaccgtcagcagccatcaactgctttgccgacggcggaacgaacgcccacgtcattctggaagcttgggaagaaaaagatacccgaatgaaaagaaagccgctgccggtaccgtcattaagacgtaaggctctggtaaaagaacctgacgtacgagcggagaaacaagagcttcctgcgaaaaaaatgttttggaaagcatttaaataagagaggagtgggaaggaatgatatcggaaaaaatcaatatctcactggatcatcccatcatgaagggccatatggtctttggtgaagcggtattgcccggtcttgcttatatcgatttgatttatcaggtttttcaggaacacggttatgtatacaatgagcttgaattgaagcacgttacgatttatcagcctttaaccgtcagtgaaacggctgcaatcattctgaccattcaatgttctgatagcggagatggaaagtggctcatctccctttcagggcagaaacagcaaggtgacgagctgtcagacaatatacaatatgcgacggctgaaatggtgaaaagagacgctgtcacatttgacgaaatcattgatttcagcgatgtgaagcagtcagccaggtctctgaatcttgatgatatgtataaccgctgtctggatcatgacttggttcattccggcatgatgaaatcaaatggacaattgtacgaaacagaaagcggcatgctggctgagctttcttgcgaagaaggaaaagatttctttttattccatccggcccttttggatgcgagcggaatcggggggagcggtttgctttcagaaacaaaccggcttcacctgcctttatattatgaatcgttcacggccgctgacaggcttcaatcagagtgcacggcgcgtatcgccgcttccggcgtccgtcaggaaaaagaactcacaacgatgacgatcgagtacttcagccgatccggacaaaaggtggcggagcttaaaaacattacgggaaaagcggttcggctcgaagacgcgaatacagccgaacagaatcaacaggctgcagctgagccggaaagcgcagatgaaaaagacatcattctgtttttaaagaagcttttggctgataagcttgggcaaccttgggagacgctggacgttcttgcaggctactacgagcttggactgaattcatcttctttgcttgagattgtacaggatatcagtaaaaagacgggtgctgacctcgcgcccactcttctctttgaatatacaaatataaaagaactcgcagcctttctgaaaaagactggttcatttgaatatgcggaggaacgtgcagccgaatcatcacgatctgaagctgaagcgccggacgcgccagaacatcataaaaacaccggagacatcgcgattatcggaatggccggccgctatccgaaagcgaaaagtgtggcggagttttgggaaaaccttaaggcaggcaccgattgcatcactgaagttccgaagtcccgatgggattggaaaacatatcaaaacgtaacgtccccgtctggaaaaacagtatcaaaatggggcggtttcattgacgatgccgactgtttcgatccgcagtttttcagaatctcaccgcgtgaggcggaaacgatggatccgcaggagcgcctgtttttagaaacatgctgggaaacgattgaagatgcggggtatacgcctgaaacgctggggaataaaggggagaaacagcatccgatcggcgtatttgcaggggtgatgcataaagattattccttaatcggcgcagaacaattatctgaagctgatccttttccggtttcactgaattatgcgcagatcgccaacagagtgtcctattattgtgacttccacgggccgagcatcgcggtggataccgtttgttcctcatcattgaccgccgttcatctggccattgaaagcatccgccgcggcgaatgtgaagccgcgcttgcgggaggggtgaacttgtcgctgcacccggcgaaatatctcagctacggaagcgtagggatgcactcaagtgacggccgctgccgcacattcggcgagggcggggacggctacgtttccggagaaggagtcggtgcggtcttgctcaagccgctggaaaaagccgaacaagacggcgaccgcatttacgcggtcattaaaggaagcgccgttaaccacgtcgggaaagtaagcggaattaccgtcccgagtcctgctgcacaggcagaagtcattaaggcctgtctgaaaaaagcaggtatcagcccgcggaccgtcagttatgtggaagcccatggcacgggtacttcgttaggagacccgattgaaattgaaggtctgtcaaaagcgttcagccaagggacgcaggatcagcaattttgttccatcggttcggtcaaatcaaatatcggtcacgcagaatcagcggcggggatcagcgggttaacaaaagcggcgctgcagcttcatcacaaaacgcttgtcaaatcactgcattctgcggaattaaatccttacctgaaatttgagggatctcctttttacgtacagcagcagactgctccgtggaagcagccggcagccgaagaaaacggaaaagtcacacattatccgcgccgggccggactcagttccttcggtgcatcaggttcgaacgcccatatcattttagaagaatacattcagcctgaacaaaaagcgcctgcacctgagaacaatgcagcaaaactcatcccgctgtcagcaagaaataaagacaggcttctggcctatgcggaaaaactagcccgatcgctttcagaaaagacggtgctgtctgaactggcttatacacttcagacaggacgtgaagcaatggaagagagagctgtcttccttgtaaatgacatccgcgacttgaaagaaaagctgaatgatttcgtaaaaggaaacgaaaacatccccggtctttggcgcggacaagccgagctgccggaactgagcgaaaccgctcccgagacggatgatccgatacggcttgccgagttatgggcagaagggaaaataatagattggaataggctgtacgcttcgggtaaaccgcgtaaaacaagcgttccgacgtatccgtttgcaaaagaacgctattggattccgcagcagaaaaaacaggagaaaagcccgtcaggcacagtgctgcatccgcttttacaagaaaacacgtcagatttttcgcagcagcgcttcacgtctctttttactggagatgaatttttcctatctgaccatgtcgtcaacggacaaaaaatactgccgggcgttgcctatttggaaatggccagagaggcggttaaaaaggctgctgccgtgacggaaaaagaccatagcgtcacactcaggcaggttgtttgggtccggccggtcatgattgaagacaaaccgaaggaaatacatattgccctttacccagaagataatggtgagattacctatgaaatatacagtgaggcagaaaacggcgaagatccggttattcacagccagggtgaagcggtcattaccgaaccggaaagcgcccagattgatatcgagtctgtcaaagcttcctgcaattcagggaccgtgactgcggaagaatgttacggtgcttttgagaagatcggtctggattacggagaggcatacagaggcgtacagcaattgctgatcggagaagaccgattattggcccgtatttcactcccggctgccgtacatgacaataaagaacagtatacgcttcacccgagtatgatggacgccgcttttcacgcctccgtcggtctgcttgtccgctcaatacatgacgatgcagacagccacgagctttctctgccgtttgcgatgcaggaagtggaagtgttcgggccgtgtcctgaacatatctggtcatatatccggtacacagaaggcagcaaagcagatgacaacgtaagaaaatttgacattgatatgtgcgatgatgccggtacggtttatgtccggatgaaaggcgcgtccgtccgggcgcttgacacaggccaaacagcgggcggagaaaccccggaagcgcctgtcggccatacgatgctgattccggcatgggagcccgttgcacttgaaaaaacgaagaaagcaaaaacagcggaaaagcagactgcggttttcggtgaaactgacagaacgcatacgcgcataaaagaacatctgccgaacgcttcctattatccgatcagaggtacggatgatatcacatctcttacgtacatgcttgaaggacaaaaagagctggagcaaatcatttggcttgctccgcaggctgagagtgcttgcagcctcaaggaacaggaaagaaacgttcttcatgtgttcaagctgatgaaagcattacttgccttggggtacggagaaaaacatttggactggtgcatcgtcacagcaaatgcccagccgttttccgatcaagacagcgccgccccgtcacaggccgcagtcagcggacttgccggaacaatggcgaaagaatatccgcattggaatatccgcatgattgacacggaaacggacggcagctggccggtcaaagaggcgctcagtctttctgccggaaaaaacggtcaaatttgggcgtaccgcaatcagcagctgtttgagcggcagctgataccgcttgacaatatgccgaaaaacggcacgctgtaccaaacaggcggggtttatgccgtgatcggaggcgccggatatcttggcgaggcatggagtgaatacatgatccgccgctacaaagcacatatcatttggatcggaagaagcacactgaatgattccatacaggcgaaactcgaccggctcagcgcattcggcccggcgcctgaatatgtttccgccgatgccgctgacagtgcttccttagagcgggcttatcagttcataaaagagcgtcacacaaaaatgaacggaatcatccactcggcaatggatctgtctgagcaaagcttaaataatatgaagacagaagagttcaaatcggtgctgcgggcaaaagccgatgtcagtgtgtccatggcggaggtatttggacgggagccgcttgactttgcgctcttcttctcctcgcttgtggcatttatccataacgtgaaacaaagccactatgccgcaggatgcgctttcagtgacgcatttgcgaaagaacttgatcagacgtggaattgtccggtcaaagtcatgaattggggctattggggcaacagcgaagcggctgaagacggcgattttattcagctgatggatcagatcggattgggattgatcgaaccggacgctgcgatggaggcgcttgaaacccttatgacgctgccggttgatcaagcagctttcattcatacgacaaaaccggtcgcagtcgaagggatgagtgaaacagaaaaaatttccgtttatccgtctcagccgcttgtctcttcacaacagctgaaggccgctccgcccggcgcacgtcttgtaaaagaggctgaacatcaaaagctcgatgattttctgtatcggcttttgatcgcccagcttaaagaagcagacttgctgacgccgcaaagccttaaagcgtatgagcccgaacacgaatattttaaaaaatggctcaatcaaacgatcgctttccttctggaacatggttatctggaagggaatgcggattcatataaactgtcggcccgtgccgaagacacaaccgcctcgctatggcaaaaatgggagcaggaaaaagaggaatggctcaataacgccgatacaaaagcgatgactgttttagccgagacgatgcttaaagcactgccggacattctgcgcgaagacgtgccggcgactgacatcatgttcccgcactcttcaatggaacttgttgaaggaatttataagcacaatcaagtcgcggattactttaacagcgccctgtcagaaacattaacggcttatgtgaaagaaaacatcagcaaacattcaaaagccgagatccgcatactggaaatcggagcgggcacaggcggcacaagcgcaggcatatttgaaaagcttaggccgtatcaaaaccatataaaagaatactgttacaccgatgtatcgaaagcttttctcgtgcatgcggagacggaatacggcaaacggaatccttatctgacgtataagctttttaacgcagaagcgccgcttgccggccaggacatagagccgggcgcatacgacatcgtcgttgccgccaatgtgctccacgcgacgaaagacatccgccagacgctgagaaacgctaaagccgtcttaaaagacaacggtttgctgctcttaaatgaaatggcgggaaacagcctgttcccgcatattactttcggactgcttgaaggctggtggctgcatgaagattctgcccttcgtattccggggtgcccgggcttgtatccggaaagctggaagcgcgtgttagaaagtgaaggctggcattctgtcttcttcccggcagaagcggcacatgaattaagccatcagattatagcggcaaaaagcaacggcgttgtccgccaaaaaacgcttaaagcaggggccggaaaacggaccgctccgccaaaagcagcacaagcgccggaatttaaagcgccgcaaacaacggtgcaaaaaggcgacacgtctttaacagaaaaaagcaccgagtacttgaaaacgttaatcggagaaacgttaaaaattccgccggctcaaattgatccgaaagcgccgcttgaaaaatacggaattgattctatcgtcgtcgtacagctgacaaacgcgttacgaaatgtattggaccaagtcagcagcactttattttttgaatatcagacgatcgaagcgctcgtcgctcacttaatcaaaacgaaaaaagacgcgatgatcaaactgacgggacaaacgcctgttcaggaagaacggaaggcatcaccagaaccgcaggctgtacagccggccaagccgcttcgcactgactggcggcggagggaaaagcgggcagccagagagaccgtccggcaaagttcggttcgcgacgtggccatcatcggtgtttcaggacgctacccgcaggcaaaaacagcggctgagctttgggccaatattaaaaaaggaaaaaactgcatagaagaaattccgcaggaacgctggaactggcaggattactacgatgaagagaaaggtaaagaaggctctatttatacgaaatggggcggcttcattgaggatatggacaagtttgatccgctgttctttcagatttctcctttggaagcggagcgaatggacccgcaggagcgattatttctagaaacggcgtatgcgagtatcgaggatgccggctatacgcctgacaacctgtgccaaagcagaaaaattggtgtttttgccggcgcgatgaacaaaaactacccgacaggctacggctactggtccattgccaacagggtatcttacctttttgatttccaagggccgagcattgccgttgatacagcctgctcctcttctttgacagccattcatctggcgcttgagagcatatacagcggttcaagcgaatgcgcgattgccgggggcgtaaacatagtgaccgacccgattcattatatgaatctgtcagtcatgaacatgctttccgcaagcgacacgtgcaaatcgttcggagaccgcgcggacggttttgtagacggagaaggggtgggcgcggtcgtattaaagccgttggagcaagcgattgccgacaacgatcacatttacggtgtgattaaaggaagcgccattaacagcggaggcaaaacgaacggatacaccgttccgaatccgaatgcgcaggccgccttaataaaagaagctttcgaaagggcaaacgtcccggcgcgcaccgtcagttatattgaagcccacggcacggggaccgcattaggggatccgattgaaatcgccggattaacgaaagcatttgatgaggatacaacagacaaacagttttgcgccatcggctcagcaaaatcaaatatcggccattgcgaaagcgcagcgggcattgcgggtctgacaaaaatattattccagctcaaagaccgccaaattgcgccgtccctgcacgcggaacagctgaacccaaatattgatttcgcgtatacgccgtttgccgttcagcaggagctcggtgagtggaaacgtcccgtcatcggcggcaaagagcttccgagaagggcggggttaagcagcttcggcgcgggaggagcaaacgcccacctcatcatagaagaatatacggcagacaaagagcctgatgagacgccggcagatcagcccgccatcatcgtcctgtccgcgaaaaacagcgaacggctcactgaaaaagcaaaacagctcagagacgccatccgtgaaaaaagatacagcggccgcgatcttatgagcatagcctttactctccagactggccgggtgccgatggaagagcgtctcggttttatcgtccattcacttcatgaacttgaggaaaaactgaacggatttatcgccggacaaaacagcgccggactgcaccgtgacggcacggaagaaaacaaacggatgcttgccgtatttgcggccgatgatgacatggaaaccatcatagacgcttggatcagcaaacggaaatattctaagctgcttgagctttgggtaaaaggattggacatcaattgggcgaaattatacggagaccgtcctccggcccgcatcagcctgcctgcttatccgtttgcgaaagaacgcttctggcatcagcagcctgtacaaagcaaggccgcgcccgttaaggcgccggctgatgaaagtgatccggcggagcagtttgaagtaatggcttttagagaagttcttaaagaacaggctctgccggctgccggagaaaagcaagtcaaaacggtgatttctttcttaactgatcagaagaagcagcaggaagccgtctctgtgatcaaatcgtatgacagtgacattgacgttatttttatcgctcagggagaccggtatgaggccttgtccgccggccgctgccaagtggtgcgggaagatccgcaatcatatgtgaacgcttttgcggatattcaaaaagagtacggtgaagcttctgccattttgtatttatgggcgcttgaagataaaagctgcatcgaagattattcatgtattgtccatattctcaaagcaatggctgagaccggtctgcagccggaaaggctgttattggcgggggaatatgcatccggtctggaaaggtgctacttggaatcatggatcggctttgagcgttcgctcggcattgttcttccgaaaacaagtgttaccggccacttccgaaaagccggcgcggccataacggactggatgagaaccatttgggacgagctgaaagctgaaacagaccataccgttttcttggaagagggaaaacgatatgtctatcacaccgaaccaaccggactaacgaaagaaaacggcaggatcagaaccggcggaacatatctcattacaggcggattaggagggctcggctacttatttgcccgccatctcgcccggaactaccaggcaaatgtcattctcacggggcggtcgccgatcaatgaagaaaagaaagaaaaaatgaaagacctggaaaatctcggcgcgggtgttctttacgccgaagccgatgtttgtgatccgatcggaatgggcgactgcatcaagcgcgcgaaagaacgattcggagctattcacggcgtcattcatgcggcgggcatcgaaagcagaacatccgtctttgaaaatgaaatcaggaatttccgcagtacgcttgaaccgaaaataaacgggagcctgcttcttgacgagtggctgaaaaacgaaacgcctgatttcatctgctacttttcatccacatctgctgttttaggagattttggatgctgtgattacgcggtcgcgaacaggttccaaatggcgtatgcccgctataaaaacgaacaatccgaaagcggaaacgcttttgtcataaactggccggtctggaaaaacggcggaatggccgtcggcggtgaagagacgacgggcatgtacctgcaatcaagcggacagcgcctgttagaaacagatgaaggcattgagctgtttgagcgcatcatttctcaagacaacacccagtgccttgtcattgccggcaaaagaagccgcgccgaacgatttttaggcatacggcgggacgattcatcaaaaccggatgcgcttttggaaaccgtgagccgccgcatcccggaagaaagcacggaaaaacggctcgaagcggatttgaaagagctgatacacagtctgctgaaaatatctaaagataaactcgtcctgcataaaaactgggcggaattcggatttgattccatctatttagccaaatttgccgctcttttgtcgagtcattacggcattgaagtcactccggctttattttacagctatgccacgctcggagacgtcatcagctattacctgacagaacacaaagaaacgatcaaaacgttttaccgaacggaagaaactgaaacaaaagccgccgctccgggtaacaaggagtacacggatcaggagatcatcgccatgatgaaacaggtctctgaggggacattagattttaaaagagtgcaagacatcatagaagggagtaagacttatgaatcataaagaacttctcgatgcctacagatcaggaacgctcaccatcgctgaagtagaacaaaagcttcaggctttcaagcggacaactgcaaaacgtccgctttctgaaggccagaaaggtttgtggatgcttcagaaaatgtttccggagatgagcgcatataacattccgttatgctttcgttttcaaaagctggatatcgagacattcaaaaacgcccttttgtccgtgcagcgccagcaccctattttgaccagtgtgataaaagaggaaaacggccttccgtatcagatagaagatacggatcggcattttccgattgaagaaatggatctttctgaattaagcgggcgtgacgctctttcgtttattaaagaaaaagcaaaagaaccgttcgcgcttgaaaccgggccgctcctgcgtgttcatgtattccggcgggcgaagcgggagccgattgtgttaatcaccattcaccatattatttttgacggcgtctctcttatgacgtttatgtcggcgctgctggacgcttatgtaaaagcaagtgaaggcaaagaacctgtcatggttcagcaggccgcagattatcatgactttgtgaaatgggaaaaagagctgctggaaagcgaagcgggaaaaacgcatctctcttattggaaaaagcagctggaaggaccgctgccggtgcttgagcttccgtcggattatccgagatcatcggttcaaacttgcaaagggcaggcgtatcagcgcttgcttcctgatgaactgaaccggcagattaaagtgtgcgcccaaaaacataatgtcaatgaatccgttgtgtatctcgctattttcaaagggctgctctatcaatatacgaatcaggaagatgtcatcgtcggcatgccgacgatggggcgctctgaggctcaatttgaatctgtcatcggatactttattaatatgatcgcggtcagaagcagggagacgggcgccaaatcctttacggcgtttttgaaggagctgcagctgacactggcagaagggctggaccatgccgcgtatccgtttcccgcgcttgtcaaagaattgaagacggaacgctcgcctgcggtttcgcctgtttttcaaaccgcgtttttctatcaaaacttcttccggacagaaggagcggaaaagctggcggaactatatcaatcactcggcattgaaatgatagaagacattcatcaggaaggcgaatttgagcttgcgcttgaagtctataaaaaagaaacgggaaccgtcctgcaatttctgtacaacccggatgtctacagcccttctttcatcgaacggatggcggagcattatatgaaactggcagaaaaggtgctttctgatccggagatcgcttttgaagcctgttccggcctgctcaatcaaaaacgtgaagcaagccgatctcatcagccgaatgagcgctgcattcatgaagtgtttgcggaaaaagccggacgccaccctgacagagaagccgtcacatacggtgaaaacagtcttacatatcgcgaattagatgaacgaagcacggcgctcgccgtgtacctgcaagaaaagggcgtcacaccggaatgcccggtcggcatttgtacggagcgttcttttgagatggtcatcggcatcctcgccattttaaaagcgggaggcgcgtatgtgccgctggacccggcttttccaaacgaacggatggcgcacgtgttgactgacagcggcgtttcaatcgtattaacgcaagcaaatacgcgcggcatgattgaacagttggccgtcggcggtgtgagcacggtggaaattgaaaagagcggacgttctgtcagcggggcaaaactgacgccgcgttcaaaaccgcatcatctcgcttatattctatatacgtccggaagcacgggaaaaccgaaaggcgtcatggttgagcacagggccatcatgaatacgctgcagtttttggaagctgagtatccggtcgcgcaagaggatgcctatttgttaaaaacgaattacgtatttgacgtttcgatttctgaattattcggctggtttatcggaaacggacggcttgtcattttgccgcctggtgcagaaaaaaacccgcagctttgtatggaatacatccaaacccaccaggtcacgcatctgaattttgctcccgccgtgtttaatgtatttctggaaacggtaaagcggcatacggcatttacagaagacggccctgtgaaatatgtgatggtggccggtgaggcatttccgaaagatttagtaaaaaaggccgtttccatcttcaaacatgccagaattgaaaacatatacggcccgacggaaacatctatttatgccgcttactacagctgcggccaaaaggaaatcacaagcaggaatacgccgatcgggaaaccgattcaaaatacacggctttatattgtcgatgaaaagctcagccccgtccctgacggtgtggccggcgagctttgcgtggccggcgccggtctggccagaggctattacaatcagcctgagctgacggcggcatcatttattgataatccgtttagtgaaggagaaaagctttacaagacaggtgatttggccagatggctgcctgacggaaatatagaatatgctggccggattgacagtcaggtgaaaattcgcggcttccgcatcgaattgggagcgattgaaacgaaattgaacgaacatccggacattcttgatcaggcggttgttgttcaggaaaagaacggacataaaaagctgattgcttattatacggcccgctccggtcatacggcagatgaaaaagcgctccgcaaccatcttttatcgagtctgccggattatatggcgcctgcccattttatccgtctggatgcgctgccgttaacaccgagcggaaaagtgaaccgcaaagacctaaaacagcgcaaggtaattgttcaccggtctgaaaagacgggcagactgccgttatcagaagcggaagcgaaagtgaccgcaatatgggaagacctgctgaatacggcgggcatcaaaaccgaagacggctttttcgatgtgggaggcgactcgcttttggctgttgcggcggcagaacgcattaaacaggagctggaatgcgattttaccgtcacggatttattcgaacactctaccattcaggcgatcagccgatttattgttgaaactaaacaggcggctgaatcagaggcatcaggccaagatgagagagaaagagaacaaacaccgcaaaacggggtgccgtcttactttgacgacagtgtggcgatagtggggatttcctgccagttccccggcgcgaaaaatcatcatgagttttggaagcagttaagagaaggaaaggaaagcgtccggttctactcggaagaagaacttcgggaagccggcgtacctgaagatttgatcgaaaatcccgactatgtgccggcattatcgacgatagaaggaaaagatctctttgaccctgagttctttcacatttctccgaaagacgcagaatttatggatcctcagcttcggcttctgctgctacattcttggaaagccgtcgaggacgcgggatatgtatccaaagagattccgaagacaagcgtatatatgtcggcaagcaataattcgtatcggtcgcttttaccggaaaaaacgacagaaggccatgaatctcctgacggctatgtctcatgggtgttagcgcagagcggcacgattccgacgatggtttcccataagctcggattaaaagggccaagctatttcgttcattccaattgctcatcatcattagtcggtctttattcagcctataaaagcatcacgagcggagaatcggaatacgcgctcgtcggcggagcaacgctgcatgcagcgacaagcatcggctatgtgcaccaaaacggattgaatttttcaagcgacgggcatgtcaaggcatttgacgcttcagccgacggtatggcgggcggagaaggagctgccgtcattctgctgaaaaaggcgtcgcaagccgttcaggacggagatcacatatacgccatgctcagaggcatcggtctgaacaatgacggagcggataaagtcggtttttacgcaccgagtgtaaaaggtcagactgacgtcatccagcatgttttagacagcacgaatattcacccggagacgatttcctatatcgaagcgcacggcacaggaacgacattgggtgatccgattgaaatgtccgcgctgcagcaagtgtataaacgttacacggaccgggagcagtattgcggaatcggctccgtaaaaacgaatatcgggcatttggatacagcagcgggtctggccgggtgcatcaaagtcgccatgagtttatatcatcgggagctggcgcctaccattaattacacgtcaccgaatccgaatatcaaattcagcggttcgccgttttatgtggcggataagagaaaatcgcttccggagagagagacgccgcaccgggcagcgttaagctcattcggactcggaggaacaaacgcacacgccatttttgaacagtatgaaaacaaaacgatcagcggatcaaatgacggacagccgccttatatcgttccgctgtcagcgagaaataagcaacgtcttactgcctatgcaacttgtttatccggctttctggatgaagccgaaaacgatgtttccttgcatgatctggcatttacgtatcagaccggacgtgaagcgatggaagagagagccgtttttatcagtcatgatcgtcacgatctgaagcgtcagctgcaggatttcatcaacggcaatgaccaaaacatcttacggggcgaaaaagtgagaagcagagaagtgtcggctcaggagatggaagagcttgcggcatgtcagacacgtgatgaaaagctgaaagcacttgcggcgctctggattgaaggagcgcgtgttgattggggcttattgtatcaggattccgcgccgcgaagaatcagtgcgccgacctacccgttcgcagaggagcgcttctggccggaagaaactgtgaagcaaacagatgcgaagtttttgcatccgctggtacatcagaatacatccgtcttgcaggagcagcggttcagttcggaatttacgggaaaagagtattttattgccgagcatatcattaaaggaatggcgatcgtgccggctgccgtcacccttgagatggcacgggccgcggcggagaaaagcatcggcggggcaacagaggattctctcggcctgcgcttaaagaatatcgtatgggtccgcccggtgatagtcgatcaggacgctgtccgtgtccatatcggactttatgaagaaggggacggacagattcaatacagaatgtacggcggtaacgattctatcggtgaagaagctcctctttataatcagggcatcgctgaaatcatccggaaggaaccggaggaagcggcggatattgagcagctgaagcgccggtgcacgcagggaacaatcgaatctcaagcgttttacaaaggaatgatcggagctgattacgggcctggctataaaggtgtccagcttgtatacaaaggcgaagaccggctgcttgctaaattgaagcttcctgaatccctctcccatacgaaagctgattatatccttcatccgagtatgatggacggtgcgcttcaggccgccgaatatttgcaaaacgtgacgagagcgctgctggcagaaagcggggaaccattcaaagccgcattgccgtttgctttagaggagctggacgttctgaatccgtgcgctgatgatatgtgggtgcacgtcacattcagtgcgaacaataaagccggcgatcctatccaaaaagcagatattgatttatatgacaataacggctggctttgtgtgcggatgagaggtttctcaacgcggatcatggaagaaaacgcgggtgccggcgtttcggtcagccgtacggacacattgttcgctgaaccggtctggaaagagcagacggcaccggccgatcatgcgccttcgtatgaagagcatatcattttcctttgtgagtacgatgaagccgttaaacaagctgtcgaagcaaagcttgaacatgcacgcgtcattatcctggacgatcgtcccgcatctattgcagagcggtatcattcttatgcgggtcagctgtttggccatatcaaaaccataatgaaaagcaagccgaagggccgcgttctttttcaggctgttacgcggtcagcaggcttacagcaggtgttctcaggcattaccggcctcttcaaaaccgcatgtcttgaacattccaagctgatctgtcaaatgatcgaagtcgaggagaaagaaagtgctgaaggcatcgcggaaaaagcggcggaaaaccgtatgcatgccgaaagcgtccatgtgaaatatgaaaacggcaagcgcattgccgctgattgggaagagatggatatttctcaagcggagccggacattccgtggaaagacgaaggcgtttatctcattacaggaggtgccggaggtttaggtctgatttttgcaaaagagatcgcaaaccgtacaaaagacgccgtcatcatactaaccggccggtccgctctcggagaaaagcagaaagacatgctggaaacagtacgtgctgccggcgcttctgttttctacgagcagaccgatgtcacggacgaagcagaagtataccgattgatccgcaatatccgtaaacggcacggcaagctggacgggattgttcacagtgccggcattataaaagacaactacatggtgaagaagacggcagaggaattccaacacgttctcgctccgaaagtgaagggccttgtgtatcttgatgaagcgtcacaacatgagaaattagatgtctttattgtcttctcatccttatcaggtgtgcttggaagcgtcggccaggctgattatgcgtctgcaaatgtttttatggagatgtatgccgagtaccgccgttctttacaagccgcaggacaaagatacggaaagacgctttctgtcagctggccgttatggaaagaaggcggaatgcaggcaggaaagcagacggaagatatgctgatgcagcaggcgggaatcgcaccgctcagcacagatgccggcatcaaggctttatatcaaggcttgatgagcgggacagcccggatgacggtttttgaaggagatgtgaaacacatgaaagcaaaacggttccgcaaagagaatgatcatccggaagcagagatcggcgtacgtcatgacattgatgctgacagcctgcttgaaaaagtgaagcatctgttaaaacagcagacggcctcgctgttaaaagtaaacattgacaaaattgatcctcatgaagaaatgacaaaatacgggctggattctatctcgatgactgagtttacgaaccagttaaacaaaacgtaccggcttacgttaacgccgacgattttctttgatcatccgacaatccatgaatttgccgttcatttaatcagtgaatacgaagaggaatttgccggacggtttgcggtaaatacaaaaacgattcaatcggcaagaccggtaaaagagactcaaattacgcgcccggccgttaagcgacgccgcactctgcctgagacacttccgcagacagtgcagcgggaccaagggccggaaccgatcgcaatcgtaggcatcagcgggattttcccgatggcagaagacattgaagctttctggcagaacctgaaagaaggcaaagactgcatgaccgagattccgaaagaccgctgggactggcgggactattacggggatcccgcaaaagaagccaataaaacaaacgtcaaccaaggcgggtttattgacggaattgctgaatttgatccgttgtttttcgggatttcaccgcgggaagcggagcaaatggaccctcagcagcgcctcttgctgacgtatgcgtggaaagcgattgaagatgccggatatgcgtcaaagagtctctcaggcacaaagacaggtgtgtttatcgggaccggaaacaccggctacggttctcttttagccaatgccgatgcggcgattgaagggtcatccgcggcgaatacaagtccgtctgtcggaccgaaccgtgtcagctatacgctcaatctgcacgggccgagcgagccgattgataccgcctgctcaagctcactcgttgccatacaccatgccgtttcttcaattgaagaagggacgtgcgacatggctttggcgggaggaatcaatacgattgttcttccggatgtgtatatcagctttgacaaagcgggcgcgctgagtaaagaaggaagatgcaagacgttctccgatcaggctgacggttttgcccatggtgaaggagccgggctctttttcctcaaaaagctgaaagccgctgaggcggatggggaccatatttacggcgtcattaaaggaagcgcggtgaatcacggcggccgtgcggcatctttaacaacgcctaacccgaaacaacaggcggaagttattaaagccgcatataaaaaagcgggcattgatccgaaaacagtctcttatatcgaagcgcacggcaccggaacagaattgggggatcccgttgaaattaacggcctgaaacaagcgttcagctcgtttgcagacggaaaagagaaagcggccggctattgcggcttagggtcggtcaaaacgaatatcggccatttatcccttgccgcgggagcagcgggcattattaaaattttgctgcagatgaagcatcgcacattagtcaaaagtctccactgtgagacggtaaatccgtatattcagcttgaagacagcccgttttatctggtgcgggagacgatggaatggaagacgcagacggacgaacgcggaaacgaacagccgcgccgcgcgggcatcagctcattcggcatcggaggcgtaaatgcccacgtcgtcatcgaagaatacattccagaagacagagaggaagcagatgattctcatatcgacccatgtcttttcgttctgtccgccaaaaatgaaaaacgcctgaaagagcaggcaaaacagctgaaacgtgcgcttactgaaaaacggtacgatcattccagcctcgtttctatggcatatactctccaaatcggaagggacgccatggaagaacgcctggcggttattgccggatccgcagaagaactgcaggaaaaactgtcacagtttatcactggagataagcatgcggatttgtacagaggaagaatagacaaaggcacgctgcaaatgctgacggaagatgaagaaattcaagaagccgttgaaaaatggatggcacgcggcaaatacgcgaagctgcttgaattatgggtcaaagggctgaacgtcgattgggcgaagctgtatggagaccggccgcctaaacgcatgagcctgccgtcgtatccttttgcaaaagaccgctattgggcggcgaaacacaccggaaaacacgaaaaaacaagcactgtatctgccggaaaacaagacgcgcttcatccgcttctgcacagaaatacttcaaaccttgcagaacagcggttcagctcaatctatacaggagaagaattttaccttgcggatcatgttgtaaaaggcgtgccgattttaccgggtgtggcacatcttgaaatggcgcgcgcagcaatggaacaggcatctgaagttccggccggacaaggaagcgtccagcttaagaatacggtttgggtgcggccgattaccattgaagacgagccggttcatgtcaacatccgtctcattcccgaaacggcaaatgacgttcaattcgacatttactgcggccgggaaacagatcagccgtccgtttacagccaaggggcagtatcagtccgccctgacgcaaaggctccggtcattgatctccaaaaactgagatcacaatccgccgagacaccgttttctgcagatgaagtgtacgatatgtaccgcaaaatcggttttgattacggcccggctttccggggtgtcaaagcgatttatacaggtgatgatttcgtattgggcagactgtctcttgatgcggcttgtgcggacacggtacaggagtatgtcatgcatccgggcttaatggactctgcattgcaggcatcaagcatattaaccggaacaaatgatgaacaactgatgcttccgtttgcggttcaggagcttgaagtattcagcgcatgcgctgccgagatgtgggtttacgccagactttctgaagaccacaaagccggacatgttgaaaaacgcgatcttgatatttgtgatgaaaatggcaaggtttgcgtaaggctgaaaggtttgtcattcagaacggctgaaaaagaacctgagaaaaaagaaaaagctccggaaacgctcatgcttgagccggtatggacacgaagcgatgaaactgctgctcaaacggaaccggtttttgcccggcatatcgtaatgctttgtgacacagacgccggactaaaacaagcggttgaagccgcgggagctgaatgtattgaaatgacctccctgcacgggaaagcggcggcgcgcttccgtgattatacaggacggatattggagacgctgcaaaaactgctgaaggaagagacggaaggagacgtccttatccagacggttctctctaaaacagataagcatcagctgctctcagggatttcagctctgctaaaaacagccggcctggaacataaaaaactgaaaacccagctgattgaaatagaaccagcggaaaacggcagaatcacagacatcatcagagaaaataaaacaagggctgatgacagccatatcaaatataaaaacggcatccgatacagcgcagatgtcaaagaaacggccgtgtccggcggcaaaatacgcattccgtggaacgacggagggatttatctcattaccggaggagccgggggcctcggctttattttcgcgaaagaaatcgcccggaaagtcaaagagccgacgctggttttgacaggccgttccgcattaagcgagaatcagcggatgcagctgaaatcgcttgaatcactcggagcaaaagcggaatacaaacaggctgacgtaacaaacgctctaactgcggcagacctggtcaaaacaattgaaacggaatatggcggccttcacggcatcattcatagcgcgggtgtgatgaaagatcaatatatcgtaaagaaaacaaccgaagagttttacagtgtattggctcctaaaacggacggatttgtcaaccttgatgaagcaaccgagcatttagcgctggactttttcatcgttttctcatccatttccggtgtcaccgggaatgcgggacaggcggattatgcggcggcaaacgcatttatggacagctatgcggcataccgcaacgcgctggttacggcaatgtaccgccacggtcacacattgtcaatcaattggccgctttggaaagacggcggaatgcaagtcaatgaagaaatggcgaagctcaccgaaaaaagaaccggtgtaacgccgatgcgcactgaaaccggaatagaagctctttacaaagcatggagcacggggaaaacaagcgtgctcgttatagaaggaaaccgcgccgtaatgcgggaaaaactgcttcaaaagactcccgcatccgcttttgcaccgattaagaaaacggaagaaacacctgcgccgaaagacctgacggccaaacttcaggaattgctggcaaaagaagtttccgggcttctgaaaataaacattgaagaaatcgatatcgaattggagttcaatcaatacggatttgattccattacgctgacggaattcgccaacaagctgaatgacacttatcagcttgatctgacaccgaccgtattttttgaatatgcgacgattcaagccttggcgcatcatttagcagaagactatcaaacgcaatttgccggcagcacacagccgaaagaagaaaagaaaagcggtgtaacagatgatggcggcatcagactggcagggaacaaacgatttgcaaaaacagccgtacagcatgttcagactgcggctgaacataaaccggaaccgatcgccattgtcggcatgagcggagtgtttccgaaggccgcaaatattgatgagtattggcgcaatttagaagagggaaaagattgtataacagaggtgccggcggatcgctgggactggcaggagtattacggtgacccgcttaacgaagccaacaaaacaaatgtaaagtggggcggatttattgacggagttgcggaatttgatccgctgttcttcggaatttcaccgctggaagccgaacagatggatccccagcagcgcttgttaatgatgtatgcgtggaaggcgatagaagatgcgggatattccactaaaagcctttccggcacgaaaacaggcctgtatatcggcacgggaaataccgggtacggctcactgttttccgacctggatatcggcggtgcgtcagccgcaaatatgagtccgtcagcagggccgaaccgcgtcagctatatgctcaatctgcacgggccgagtgaaccgatcgacacggcttgttccagctcgctggtcgcgattcatcacgccgtatgcgccattgaaaacgggaactgcgagatggcgatcgccggcggcgtgaataccgtcgtcacaccgcaaggccacatcgcttatgataaagcgggtgcgctgagcaaagaagggaaatgcaaaacgttctccgacagggcggacggatttgccgtcagtgaaggtgccggaattctgtttttgaaaaagctgtcagaagcggaaaaatcaggcgatcatatttacggcgtcattaaaggcagcgcggtcaaccacggcggacgtgcgaactccttgacgacaccgaatccgaaagcccaggcggaagtcgtcagaacggcttatgacaaagcgggcattgatccgagaaccgtcacttatatagaagcgcacggaaccggaacggagcttggcgatccggtcgaaatcaacggcctgaaatccgcctttcaaaagctgtacgaaaaaacaggcgatcccgccgtttacgcgagtcactgcggtttgggatcggcaaaaaccaatatcggccacctgtcactggcagccggtgtcgcgggtgtgatcaaagtgctgatgcagatgaagcataaaacacttgcaaaaagcctccacagcgaggtcatcaacccgtatatcaaactgaaagacagtccgttttacatcgtacaggaaaaaagagaatggacagcattgaaagacgaaaacggcaatcatctgccgcgccgtgcgggaatcagttctttcggcatcggcggcgtaaacgcccatgtcgtcattgaagaatatatcccgaaggaagaaagaaaaacagctgttttcacacaccctcaaatctttgtgctgtcggccaaagaagaagaacgtctgcaggaacaggcgcagcagctggcgcaagcttcttttacggatgcggatcttgccgatgttgcttacacgcttcagcaggggcgtgatgcgatggaagaaagagcggccattatcgcttcctcggccgaagaactgcgggacaagctaaagagctgtgcgaaaggacgttatgacaaagcgggcatttataaaggaaaagcgggtaaaatcccgctgaaatccattatggcaggcgcaaacggcgaagcggatatcgaagagctgataagccgccgggagaatgacaagcttgcggaattatgggtgcagggcgcggatatcaaatgggacggcttatattctgatatcaagccccaacggatgagtcttcctgcttacccgtttgcgaaagagcggtactggatcacggacaaccggccgaaagcagaaaaaccgcaagctgtgccgacggcgcgggtgctgcacccgctgctacacgagaatgtatcggatttaacagagcagcggtaccgatccgaatttacgggacaagagacgattttcaccgatcatcttattaaaggcaagccggtcatgccgggcgtcgcctacttggaaatggccagggcggcggttgctcaggcagtcaaagggcaaaaggaagttccgtctgtcatccgtctgaaaaacatcgtttgggttcggccgatcgaagcggaaaaccgcccgattgaagcgcaaatcagcctgaacccgaggggaaacggtgaaatcgtgtatgacatttacacggattcacaaacagaagcaagcggcaggcagatacactgtcagggggctgccggcattctcggcgccggggaggctccgcaccgtgatataggcgcactgaaagctcaatgcggcctcagcatgctgacttctgaacagtgttacggcttattcaacaaaatcggcattgactacggtcccggacaacaaggaattcagcacattcatatcggaagcaatcaagcattagctgagctccgtctgccttccttcctcgaagaaacagcagatcaatacgttcttcacccgtgtatgcttgattcagctctgcaagcgacaatcggactgaagctgcatgcagatgataaccagctgtcactgccgttcgcccttgaggaactggacattttcagcccgtgcacgaccagcatgtgggcgtatgtcagctcccggggaacggatgaaaaaatacagcggctggacattgacttatgcgatgagacaggccgcgtctgtgtcaggattaaagggatttcttccagaatgatggaaggaccggcgccggaaacatcattaaatggagcaaaccttctggctccggtatgggatcttgcggaattccgtgaccaaagcccggcatataagacggaagaggttgtctttatcgcaggggatgaggaaagcgaggcttttcaattgcatcatccttctgcgaaacggcttcatatcaacccggaggatgaaatagaggctgttgcggctgaactgaaagcaagagggtctttcgggcatatcgtatggatcgctccttttcacagcgatggtgacatggtgaaagctcaagatgcgggcgtcatccagatgtacagagtgattaaagcgatgcttgctttaggatacggaagcaagcgaatcagcttgactgcagtcacaataaaaacacagtccgtacagccggcggacatcattgatccggctcatgcaggcattcacggtttgatcggttcgctcgcaaaagagtatccgaactggcaaacacggctgattgatgccggatgtccggaagatgtttcaaaggcggagctgttctcagcgccgtttgatgagcaaggcaatacatgggcgtaccgcaacaatcactggtacaaacagcgcctcatccctgtacagcagccggtgtcaagccggcccgcttaccaaaaaggcggcgtttatgtcgtcattggcggcgcggggggcatcggcgaagcatggagcgaatatgccgtgaaaacgtatcaggcgcgagtcgtttggatcggcagacgaaaacataacagcgccatccaggaaaaaatcgacagactcagccaattcgggccggcgccgatttatattgaagctgacgcggcaaacccggatgagctcacacgggcgtatgaaacgatcaaacgcacgcacccgcaaattaacggaatcatccattccgcaattgttttagaggatcagagcctggcgaatatgccggaaagccgtttgagaagcgtgctcgctgcaaaagtcaatgtcagcgtgaatatggccctcgtgttccaaaatgagccgctggactttgctttgttcttctcatccgttcaatcatttgcgcgagcggccggacaaagcaattatgctgccgggtgcagtttcaaagatgcctttgccgctcatttggctcaagttcggccgtattcggcggcagtgatgaattggagctactggggcagtgtcggaatcgtatcatctgccgaatatcaagaacggatgaaacaggcgggagtcggatcaattgaagcgccggaagcaatggcggcgcttgaacgattgctcggcggcccattgaatcagttcgtcatgatgaaacaggcggaagagccggaggaaaaaccggaagaaatgatagaagtataccctgaacatcacggctcggcgatgcaaaaactgcgaagctatcagcctaaagtaacaagacatgtacaacaattgagttaaggaggggacggctttgcaaaacactgaagatcttctttacaaactattggcaggccagctgaaatctgtcggattttttacggaaaacgaaacgcagcctgttatgcaggggttttacggcaggtggctggaagaaagcatctccatcttggtgcaaaaaggctttttgaaacagtctggcagtacgtatgtgttaacgggtccgatagagcgtgcggacgttctgtggcaagaatgggatgaaaagaaagctcctttactcaaggacagcagcaaacgggcgatgatcaccttagtggagaccgctctcagagctttgccggatattttatccggcagagtttctgccactgatgttctgtttcctgattcctcaatggaattggttgaaggaatctataaaaacaatgaaacggcagactactttaatgaggtgctcgctgacacattgacggctttcattgaagaacgcctgaaagaagacccgaacgcggaaatccggatattagagatcggagcggggacgggcgggacgagcgcggccgttttcaaaagattaaaagaggtcaaacatcatgtgaaagaatattgctacaccgatctgtcaaaggcctttttcatgcatgctgaaaaagaatacggtcccgacaatccgtatttgacttataagcggtttaatgtggaagagcccccggctttgcagggtatagaggcgggtgcatatgacgcggtaattgcggcaaatgtgcttcacgcgacaaaaaatattcggcggacacttcgcaatgccaaagcggtgcttaaaaagaatgggattttgctattaaatgagatcagcagccattcggtttattctcatctgacattcggtcttttggaaggctggtggctgtatgaagacgccaaactgcgtattcccggatgccctgggctgtatcctgaagcgtggcagtctgcgctggaaagcgagggatatcggtacgttacatttatggcggaatcgtcacatcacctcggccagcagatcgtggcagcagaaagcgacggcgtcatcaggcaaaagcagccggacgcgccggcggttgaagaaattgcggcttccaaagagccggctgatttcacagaaccgtctttctcagtcacagaccggacggtgcaattcataaaagaaacgttagccaagtccataaagcttgctcccgagcgcattcagccggaaaccagctttgaaaaatacggcatcgactccattttgcaggtgaattttatccgtgaactggaaacattgacgggcgagctgccgaaaacggtcttatttgaacacacgaatacgaaagaacttgccgagtatttgctggaaacttacccggataagctgcaacaggcattcggagccgatcaagcgcctcctgaaacggagcatccggaacctgcaatgaatgaaccggtgccgcttgtcacggaaacgcggcgatttatcactgaacaaaaagagccaaaagcgccaaagccggaaacagaaaccgtcaccgataatcgctcagatcgtgacgacattgccattatcggcatcagcggccgctatcccgagtctgaaaccctcgatgagctgtgggagcatttaaaagccggagacagctgtattacggaagctccggaaaacagatggaagtccggtcttctgaaaacgatggcaaaagaaacacgaaaagaagaacgcaaaacacggtacggcggatttctgcagcatattgacgcttttgaccatcacttgtttgacatccgggaagaccatgtgatggagatgacacctgagctccgtctaagccttgaaaccgtatgggaaacatttgaaaacggcggctactcgttagagagagtaaacgaatggcaggaatcagacagcggaatcggtgtatttatgggcagtatgtacaatcaatatttctggaatatcccgtcattggaaaaagctgcgctcagctctaacggaggggattggcatatcgccaaccgcatttcccactttttcaatttaacgggcccgagcatgggcgttacgaccgcatgctccagctcactgagcgccattcatctcgcctgtgaaagcctgaagcttaacagctgttccatggcgattgccggggggtcaatctcacgcttgaaccgtctaaatatgatgcgctcgaacgggcgaatttgcttgaacagggaagtgaaagcaaaagcttcggaaccggcacggggctgatgccgggagaaggagtcggtgcggtgctcttgaagccgctctccaaagcggttgccgacaaagaccatatttacggggtcattaaaagcagcgcgttgtgccatagcggcggaaggcagatgtacacggctccggatccgaaacagcaggcgaagctcatggcggcttccattgacaaagccggaatcaatccggaaacaatcagttatgttgaatcagcggcaaacggctctgtattgggagatccgattgaggtcattgccctgacgaacgcgttctcgcaatataccgataaaaaacgattttgcgcgcttggatccgtcaagtcaaatctcggccatttagaggcggcctccgggatgtcccagctcgcgaaagtgctgctgcaaatggagcgggaaacattagttccgaccattaacgcaaaaccgcaaaatccgaatatcgcgcttgaacaaacggccttttacctgcaggagaaaaccgagtattgggagcgtctgaaggatgccgagacgggagacatcgtaccgcggagaagcatgatcaattccttcggggcaggcggggcatatgcaaatctcatcgtagaagaatatatcagcccgaattccgatcaggcccgtcacggcgatgaggaatatattttccctgtgtcagcgaaaacaaaatggagttttgaagcctatcttgagagactggcggcctttttagaaaagacgccatctcttcatccggccgccatcgcatctgcgctgcaaaaaagaacgcatcatccggagtatcgggcggcatttacggctgcttccgttcaggaactgctggaaaaactggccgcttaccgcatggatcagcggaatctcaatttctccgattctgatatcggccggcgtgcgcggcaatgggaaaaaggagagaatatcacgtttgatcagttgcagcaagagcacgccgttcatctgccggcctacgcttttgaccacgggacttcttttcatttcggtgaatcagaaaacgctgccggcgttcaggcggtatacagtgatgacgacccatacgtgaaagggcatcaattcggcggagaaccggtactcgtcggcgctacatataacagtctggcagtcgatcatttttgtgacctttttcctgaagcggaaggaggacatattaaaaaactgaattacgtcagccccattaccgtaaaaaaaggcgatcacatcgagctgaaaacagaatcgaaacaaaacggggatggatttgaactgagcataatgcaccgcagccgcacgtctcctgattggagcatagcggcgtatgccgagtgcagcccgtatccgtttcaaaagcagcacgcagatctggcggccattcagcgctcttaccgggaagtgggccggatagatgagttatacggagatggaacgggaaccgtcgtgtggggagaagaatttaaaacgatcacccgtctgtacaaaggcactgatgccgttttagcgaaagtgaacctgaacaatagcgactcacaacaagcgcatcattatgccataaatccattaatcgccaacagtgcttacttggcctcgctttctttattggaccaaacagagacggaaagctatctgccgttcggcattaattccgtcaccttcagcagcccggaaaatcttaccgattgctggctgcacatcaagctggctaaacaaacgggggaaatgattctgattaacgcagatgtcatcagcagccgatcggaagtggtgatgcgttttgaaggctatgccctgaaacggttccgcccgaaaaccgaacagatgaatcagccggcccgaacggctgttaagaatgcgggagcaccgatttctgccggcagtctgacagatgatatccgcagctacgtccttggcaagctcgccaagatgatggatgaacccgcgtcatctcttcgttctgacgcgaatatcatggaattgggacttgattcagcgagtctgatcgggctgacaaaagagatcggccaagaggcggacatcgatgtgaatccaacattgtttttcgagtatccgacggcggaggagctgacccgccacttcgcgtcagcatatgagagcaagttttctcaattgcttgccgatcataggcattcagaagaggccggggtcacggaaacagaagagcgcactttaccgaagaaacagcatacgccttgtgaaaacgccgatgtcaagcaaggaatcgcgattatcggtatgtcagctcagtttccgcaatccccggatatccagtctttttggggacacatcgtaaacggggatcactgtattaccgaaattccggcggaccgctgggactggcgccgttacgccggcgatgagaatgacacgagtctcagatggggcggttttattgacggtgtcggcgaatttgacccgctctttttcggaatttctcctaaagaggcatcacaaatggggccggagcagtttctgcttttgatgcatacatggaaggcaatggaggatgcgggcctgacaaataaggcattatcaagcagaccgacaggcgttttcgttgccgcgggcaacagcgatccgaacaatggaacagccattccgtccatcattccgaacaggatatcatatgccttgaatttacaaggaccgagtgaatattacgaggctgcctgcacgtcaacgctggtggcattgcacagggcggttcaatcaatccatcataacgaatgtgagcaggctgtcgtgggcgccgccaatattctgcaatcgccgaaaggttttatcggttttgactcgatgggatatttaagcaaaaacggccgggcgaaatcgttccaaaaagatgccgatggctttgtcagaagcgaaggggcgggcgttatcatcatcaaaccgcttgaggcggcaattgaagacggcgatcatattcacatggtcattaaaggaacaggagtgtctcacggcggtaaaggcatgtcgcttcacgcaccgaatccggcgggaatgaaggccgcgatgaaaaaagcgtacgaagacaccgatgttgatccgcaaaccgtcacttatattgaagcgcacggcattgcctccgaaatggcagatgcgctggagtttaatgcaatcaaagcgggttacggcgagtctgcaaatcaagaggaaagcgcgccttgttatatcagcaccgtgaaaccttgcatcgggcacggcgaactcgcttccggactggccgcccttataaaagtagcgatggccatgaagcatcataccatcccgggcattcccggatttacagctgcaaatgagcaaatggttattcagaaaagccgcttccgtttcaccgaagacaatcaggaatggtcacagctcaccgaccatacgggcagaccgatcccgcgccgggccgcaattaacagctatggcttcggcggcatgaatgcgcatgtcgtcttggaacagtacagtccgagccataaagacaaagaatctgcgcatgacccgcagcttatcgtgctttctgctaagagcgaagggcgtcttaaggcggccgcaggtcagctggctgattttgtgcaaactggagatactccgtcactgcgggatattgcttatacgcttcagaccggccgtgaggcgatgaactgccgcttggcactcgttgcccgcaatcaagatgaattgctggaaaaactgaaagagtacagagcattttccgaagaaagcaatggaatgaaaagcttctttacaggcagtcagcagactggatcaggagatatcggcgttttactggaagggactctcggtacagtcgtcacggagacgctgttggctgaaaacaatctggaaaagcttgcattttgctgggtgaaaggagcggatataccgtgggacagactccaccaaggcaaatctgttcaaagagtgccgcttccgacatatccttttgaacaccacaagtattggaatggcggtcagccagaagacatcacccttgcgccggtttcccaggaccctcagctccgccgcgagagcgcagctgacattgtggctgacattttggggatgaaggcagcggaaattgatcaaaataagccgctgactgaatacggctttgattcaatctcctctattcagctgctgaaaaaacttgaggacggagacagccgcatcagtctggaagctcttcagaaatgcagcactcttcaggagatcggcatgctgttaaaaacgaaccagccgcatgaagcgggccggaattttcccgaactcgtcaagctgaatgaaagagaaaaaggccgtcctgttttttggtttcacggcggaacaggaggcgttgaagcataccagccattcgccaaaaagagtcagcgtcctttttacggcatccaggcaagaggtttgacagggaaagagccgctgcaaggaatcgaagagacggccgcttcttatatgagaatcatccaagcggtacagccgaaaggcccttatgacctcggcggatattccttgggcgggatgcttgcttatgaaaccgcgcgcctcttgcaggaggaaggtcatacagtaaaaagcgccgtcatgatcgacaccccgtacagtgaaaaatggaaagagagaaaaccatctgttaagtcagtcatgctgcaaacgatcaatacgatgcttacggcatatcttaagcctgaaaaccttgaagaggcattaatcagcagagaagacattaccgtccaggctgaggaagaagaagtattgaaagaattgatcggccttgccaaaaagcgcggtctgccaaaatccgaagaagcgatccggatgcagctggagcaaatgatgaagacgcagctcgcttacggaatggaagagtatgacatgaagccgctgcctcatccggaagcgctgcaatgctactacttccgtaataaaagcggtttgtttctcggagattttgaacgttatctgacagcagaggaagaacaaattccgttagaccatgatgcgtattggaaagaatgggaacaccagatgaaacactttcacctgctggacgtccactcttccaatcatgtcacaatgctgtcggaaccaaagccgcaaaacgccattaaggcattctgcgaaaaactgtacgcaaacaaaggaacgataagcgcaaatttccttaaatctttcaaaaaaaagctggacgaaacaaatgagttggtaaaacggtaatagagaacggccggagcaatccggccgctttttttacaatagaactaaatacactatgtactaaatattcactgttatattgatttcctgtttataagacattaaaaaacccccgataaacagggggcgatattaaaatctgacaggcaatgtttcaagccctctcaaaaacacgttttttctccactttacatcctcgtgcgcgcctttcagctctatattcggaaaccgttttaaaagcgaagtaaaggcaatggatgcttccatccgggcgagcggagccccgagacaaaaatgaatgccgaatccaaaagagatatgacggttcggtgttctcgctatatttaatgtatcaggatcatcgaaatattccgggtcccgattggctgaaccgatgccgataaatatcatatcgccttttttaatagaaacatctttataggtgaaatcttcaatcgcccatcgattcgccatcatgatgacgggagaggtgtaacgcaaaagctcttcgaccgccgtctggatattttcgggctgtcgctttatcttctccatctggtctttgtgcagaagaagcgccagggtgccggagccgagaaggttaaccgttgtttcaagcccggcaacgactaacaaaaacagcatggaatacagctctgattcactcagcttttggccgtcctcttcagcgtaaataagcttgcttgtcagatcttcagcgggatgttttcttttttcttcgatcagtgttttcatatattgtttaaattctttgagagcctggttggtcgcatcttgtccgctctctgacgtgtcgaccatcgcgtttgtccatacttgaaatttggcgcggtcctctttcggaattccgagcagctcggaaatgacgataaacggaagcggtgccgcgaaatctttcatgatatcagggtctgcttttgtttccatttcatccagcagctcttctgtgatctgctctatcccggtgcgaagctgctcaatcatccggggagtgaacccctgatgcaccaaagatcgaagacgtgaatgatccggagggtcttttgccagcatatgctctgagacaaaatcgatatcttcgctgacattcagcttcgcgatcagctccttcggcataacccgttttacatctctcgtaattctgccgtcttttaaaaacgccatacaatcatcataacgcgtgatgagccatgccggaaaggtgcctccgaaacgctgcagttcgaatttatgtatggggtcctgctctctgaatctgcttaaaaccgcaaaagggtcttcgtgaaactcgggtgagtgtgggtgaaacattgttttttccatctggatttccccgccttcatgtttttgaaaagacataaccaacagccggtgcctgccgaccggacggcattcctccttttatctgccgaagacactgatcacaacggctcataagtatgtctaaaatatataaggaaaaagaagccggttcaatagacaaatcgtaaagccgccattttcgttgattatcaacaaaacagcaaactttttttgccatttcatcatgtgtgttaaatccggctaatatacatatttacgcttcatatcaacttcttaaggaggatgtgaatgaatgcgtttatgaaatgggcggcaagtctgcttttggtgatctctcttcagttcggccttacgggcgccggcatccattcggacagtgctgctcatgctgcatcccgatacgatcaggtgctgtatttcccgctgtcaaaatatccggagacgggaaatcatataaaagacgccatttcggcaggtcattctgagatttgtacaattgatcggggcggagcggagaacagaaggaaagaatcattgaaaggaattccgacaaagcccgggtttgaccgtgatgaatggcccatggcagtctgcacagaaggcggggcgggggctgatatcagatatgtaaccccatcggataaccgcggggccggttcatgggttggaaatcaaatgagcggctattccgacggcacgagagtattatttatcgttcagtaacttctccggttcgccggagtttttttatgctttgaaaaagcggcacgccggctggacatatgaaatggcaaagagtaaacttatatgttggaatcagcatgagaaaggattggatcacattgacagtgactacataccgaaatattgcacttttacttctttgtttaacagcgggaattgtggatgtgatcggttatttaagcctgggacatatctttaccgccaatatgacggggaacatcgttctgttcggcctggcgatcggcaactcatggcaccttgccgtactcaaatcgttaacctcgttaatcggatttattgccggcgttattgccgcggccctgcttgtgggcaataaaaagaaatcattctggccccctgcggtaactgccgctttagctattgaaggagctgttttgctgctgtttgctttgttctcctgcttttttgcagacgccatttctgtttatgtgctgattatgctgctcagcttcgcaatgggaatgcagacgacagccgcgagaaaacttggtgtagcggggatttccacgaccgtattaacgggaacgctcgctaatttttttgaagatctcaccgcaaggttttacaaagcggacaagcggaagcagtttacgagagatgctgtattgcgcgcgcttgccttggttctgtattgctttggggcggtcataggcgcttttgccgaaccggattataagtttgccgtgatctggctcccgattatcattattttaggcattatgctttgcgcattcacgatgttccacggatattctgaagaaaaaaaccaataaaaaacgccgctgtttcacggcgttttttctttttattgctctttccgggtcccgattgtatacacggcccgatctgtatgtacctttaatccgtcttgctcctgttggatggtaatgtcgccgagcagaggaatttcatacgcatcttggggaagcgggacatttccttcctccgtataggttgtgccgtgcccttttaagacgagttcttcatccgctacatagtcatcgggatggtttgtccggcggacgagaacgtcatcaaggtgaagcatgatctgatccatatcagaaatctcgtttcggctgtctgtcagctctccttttctgatatcaagcgtttgtccgatctgtttttgcagccattcagacaattcggtgtttgtaagtgccattgtgattcctccttttatctacaccatacttattccctatttttttagaaatacactgccttgcgttgatctttttttctgacagccggttctgacctgttccgagttccttcattataaatgtttcatctattcacctgaaaaacggagtcatctgccggtgcagacgaccccgttctcatgataaaaaggttactctttcggcacggcgttttcggcgttcactgcgcccgctccgtaaatgttcggatcttcatttgtccattgatccggactttgtctgatcaatgttttcacttcgtcaggcgaaagctgcgggttttgctgaaggattaaggcagcgatgcccgcacagatcggagtggccatggacgtgcccgacagactgaaatacaaggagcctactcggtttgatttctgtaatttgtcaagatatgaacgcggagaacgaagagatacgatatcgaccccgggcgcaagaatgtcaggcttctcttttccgtacaccgtcgggccgcggcttgagaaagaagcgaccgtatcgtcctcattgctggctgtatcattgtcatcataggcgcctaccgtgatgaccttctcgctgacaccggggcttgaaatcgtttgagcttccggaccggagttgcccgcggcgacgcagacgacgattccttcattccatgcctcttcaacggccttgacgagcgggtcgtccgtttctttatcatatttgagcgcatctccgcccagcgacatgctgatgattctgatcggattctttgtgtgttctttattatattgtatgcaccattccacaccttcaatgatatcagccaaggttcctgatcctgatttgtttaaaaccttgactccgatcagatcggcttccggcgccggcccctgatatttacccgaagatgaagcgccgctgcttgcgatatcaccggcgcaatgggtgccgtgtccgttgtcatcatacggttctgtcttttggttgacaaagtccgcaaagccgataatcctgccttctaaatcaggatgctgatagattccggtatcaataacggcgacggttacgccttttcctgttaatacggtgccgttacgggtcacttcttttgcatgagacgattcagctgctgtatcaaggagagcttttacttcacggtttaaatagattttacggatatcccggcattgcgaaagaagcatgtgaagggcggacggcgtgacttcggcgctgcagcaattgattgtttgaaactgcttttttatggtgcagcgtttttcttttgataagacctgtcctgtgctgtgaaaaccggattcatggcagccctcttcaaattcaatgatgactgacattttctttctgtttttcacctttttttcgaaaaaattgtgtaaaaagcaaggtgtccatttgaaaggtttatataactgtaatacgttttctctgagcggccagtccagcttatgagcatttgaccgcaccatttgtaccattgagtaaccaaacatatatacttttcctcccattctggcgattctctctataccatatgaacaggccgtaagttcggtcagtttgtttgtccttcaggagcgctggttacttgcggctttttcaggagaagaaatcgagttgaaacggaacgtttgttcgttttgtaatgaagccggcggaaggtagtatatacatgaacatcatattgagacattccttggaaaaacagcttccgattgatattatatatatgaataaagagacggctccgtttcaaaacggaccattatgataaaaaaaggggatgagcgggctgtaatggcattttgctgtacaaaaaggcagatgagaacttttttgacgggctccattctgtcctgcgcatttgcttcgggaggcggatattcatttctaaaagcgtattcttgatgccgtccgtttccggccgtgaatctcccgcccctgaaaattcgggcgttcctccctttttttttgccctctctcaaccttttttcactgatgcccggcatttgagcgcttgaaccgtgacaatccattgatttttcgaaaccgggaagtttttcactgatgataatgttaatagaatgttaagataagacctattgacaaaaatccatataatgaatatttcatttttcagaaaggagcaaagaaggagagctgatgaaaagaattttacttaatgtcatcattatcgtagcaatggtcttactaataagatgtgctcattatgcgtcagaccctgatccctcgaattcttctgatacatacacagattttaaagatctggctgaacatgaagaccccgatgattatcatatatcgtacaataagagaaaggggagccccgtattgatcatgtccccgcacggagggagaattgagggcggggtgagcgagatcgtccgctctttcagggatgattattcaacctacctgtttgagggattaaaagcgcatgataaccagactcttcatattacgagcaccaagttcgatgagccttcagcagtcgaaagcattaagcagcaccattatgttatcgcagttcacggttataaaggcgacgagaaaaatactcttgtcggaggaagcgaccggaagcgggcgaaaaaattggtgagagctctcaaacgaaacggatttcctacagaattggcaacctcaaaaaccggtctggccggggttgacaccgaaaatatcaataaccaggcgcaaaccgggctgagtatacagcttgagatcagcagagaacagcgggaggcgttttttgataattttgattaccgcgaaagggaattcacaaaaacggaggaattttaccggtttgtccgtacgataaaaagagtgatcaatcaagagtattcgtgagcttaaaaaaagacaaaccagtgaaaggtgagtaaactgaaaaaaaaggaggtttgtcccttggcaaaacatcacttttatttaaaagcaaattggcccggaaatcgcaatgacgtcggcgatattaaaagcggccggctggaaaccgctgtgtccattcctaaggaaatggacggacccggagaaggcacaaatcctgatgaaatgctgcttggagcggccgcgacctgttatattataacgcttgcggcgatgatggaaagaagcggcctggataaagaagatctacatatggaatctgaaggaattgtagacgtcacgaacggtgtgttcacgtaccagaaaatcattcaccgcccgtttatattattaaagccggatgcagccgaaacggactttacgctcgccaggaagttagcgcaaaaagcggagtcctcatgtatgatttcacgagcggtccaaggaaacgtggagatggagcttgaggttgaagtaaaagctgcccgcgcttgacgagttcaaacggtcagctccgggccgtttgattttttttagctttttgagacttggaacggttcagcaggatgacgcccgtgatgacaaaaataagcccgatcatcattttagctgtcatggcttccttaaaaacaaaaaagccgacaattgccgttaaagccgtgccgacacctgaccatgtcgcgtatgcggcggataaatcaaggcttttcaaagagaagctcaaaaacataaaagaggctccgattccggcaatgacgccgagagcgggccataagtgcgtaaaaccgtccgacagcttcagcatcgtgcttccgaacacttctgatacaatggctaatgccaggcagagtaatcctttcatatcatgcttctcctttctaccaattcatcagaatgacaccggccaataagaatacaagtccgatgacggcctgcttgtccagtttttcatgaaaccatttcgctccgataatggatgcgagcaccgttcccgctccgctccatgttgcataggataagctgagcggaatgagattcagtgtaagtgaaagcatataaaaggccaatgaatagcctgccactacaagcgcgctcggcaaaaaccgcgtaaatccgcgggagaccttcagcatggccgcgccgattgactctgataaaatagcaattgtgaggaagatataacccagaatcatatcaaatccccctctcatcataatccttatgccttttgtttaaggcagtaaaataaaataatatccgaactttgcccgccaagtcaagacattaggcctatataaaaaggcccctgaaaggagccctttttgattgtcttagtagtaatacggatagtaagggtagccgtaacctccgtacaggtacggattgaataaagcgcttccgacaagcccccgacaagccctccgaagaacggtccgccgtaaaaaccaaacggccgtccgaatccataaccaaaccaaggccggccaaatccaaaacccggccgcccgaagccgaagccgaatccgggccgcccgaacccgaagcccggccgtccaaacccaaatccgggccgtccaaacggtctcatatcactatctgctgcatatgtgtattcttcattcataatttaggtacctccaagaataaatttgagatgataacagagtattcagcccaccaatttttgattgggcatttatcaaaaaaataaaggagtgagcttttgtgggcctgtatcagtccgattggtcaaaaaaacctccgcacacacacgcataccgggctgttacggatgtagtgcaggggcactaccatatgatcgaaggcttttcgcagccggagaacggcagcaatacagatgagcatacacatttctatacgggcatcacctcgtttgaaaacggccattttcataggtattacggcatttccggccctgccatcccgagggttgacggaacacattaccatgagctttcagagaccacctttgccgcctacaatgagccgattcggatccagcatggcggcgtcgtttacgatccgcgggaggaaggacggaaaacgcaccgccatacgctcaaaggaaaaacgagagaggttgtcggaaacgagccgatcgggtggtagcggacgtttagcgctcaggaaaaagggcaaaatggataggtgcctgaagaaatgaatgctataattagggggagatttataaaagagagtgatacatattgaaaaataaaaaacagcctgtcgtcatactcgtcggaccgacggcagtcggaaaaacaaaactaagcatcggactcgcgaaaatgctgaatgcggaaatcatcagcggagattccatgcaggtatataaagggatggacatcggaacggccaaagtcaccgaagaagagacagaaggcgtgccgcatcacctgattgatattttggagccgtccgacactttttcaacggcggattatcagaaaatggtgaggggaaaaatcaccgagattgccggtagaggaaagctgccgatgattgtcggggggacgggtctgtacattcagtccgtgctgtatgactatacgttcacggaaaactccggcgaccctgtattccgggagcgaatggagaaactggcggctgaagaaggggcggaagcgcttcatgccaagcttgcggcagccgacccggaagcggcggcagccattcatcaaaacaatacgcgaagagtcatccgcgcgctcgaaatcctgcatgtatcgggaaaaacaatgtcagagcatcttaaaacccaaaaacgggagctgctttacaatgcggttcttatcggtcttacaatggacagagaagtactgtacggccggattaacgagcgcgttgacctgatgctggaaaccggccttcttgacgaagtaaagcggctgtatgatatgaatatccgggacagccaatcgattcaggcgatcggctataaagagctgtatgaatatcttgatggaaaagtgccgcttcctcaggccgtggagcaattaaaacaaaattcaaggcgatatgcgaaacgccagctgacctggtttcgcaataaaatgcccgtttcatggacagatatgacgccgcctgttgatattgagcagaaaaaaaaggaaattttcgagtgcatagcaggaaaactggaaatttaatcgaaacagtattgtattgagaaccaaggaggacgaaacatgaaaccgattaatattcaagatcagtttttgaatcaaatccgaaaagacaatacgttcgtcacggtgtttttactcaacggctttcagcttcgcggccaggtaaaaggctttgacaactttaccgttttgctcgaaacggaggggaagcagcagcttatttataaacatgccatctccacgttcgccccgcaaaaaaacgtccagcttgagcttgaatagactttttgacaaagaccatgaacaatggtctttttctatgcgcgtctgtatattgcaggccgtatatcggaaagataaaagggggttcggaaaatcgtgttcgaaagtgaaaatgaactgagaagaatcaggattacgctcgtttggatcgctgtttttttgctgtttggagcttgcagcaatcacgagacggtggtgacggatgatgacggcggcttggcggatgccgaatcgcagacagaaggcatggtgcagctggaacataatcgtttcggcattgtcgagggcggttatctaaaaatataccgctatgatgaaaaaacgaataaaatcgaactgaaaaaagaaacggcgctggatgagcttgaataaatttcacaagcgttcgaatttacaaagcgggccgcacaagctacactaagtactgacattgatcatgcagagggtgagacgattgaaacacaaggtgataatcaaccattgggaagaaacttgtgaagatgattcctgctatgaatatggaaccagcatcatcgttgacggcaaagaactgatcagggaggcttccatcacaagcgctctgaaagccgtactgaaagaaatcggtgctgatgtagagattgaagaaaccgttgaaagcgaaaaaaaatgtgattcttacaaaaaataagaataaaagtctagactactaagcagttttttttcatgttatgatagacatcggcttacacatgacaccttgagtaggatgagagatgattctcgttctgctctcttttttgggcgttaatcgggccggagccaaagtccgctctttcaaaaatatgaattttttataaatcgatctcaatatgttgtgtttttctgagaggttagtatactatatatagtgttaagagattcattatttttgataggtcgtgataaggatggttcaaatcatatttgattcaaagacagggaatgttcagcgttttgtgaataaaacagactttcagctgatccgcaaggtggacgaaatggaccacgtggacactccgtttgttttggtcacctacacgacaaacttcggtcaggtaccggcatcaacacaatcatttctcgaaaaatacgcccatctcttattaggagtcgctgcgagcggcaacaaagtatggggcgataactttgcaaaaagcgccgataccatctctagacaatatcaggtgccgatcttgcacaaatttgaactcagcggcacatctaaagacgttgaattgtttactcaggaggtagaaagagttgtcacaaaatcaagtgccaaaatggatccagttaaataacgaaatcatgatccaacaagatggaaaattccagtttgataaagataaagaggctgtacatagctattttgtagactatatcaatcaaaacacagttttctttcacgatttaaaagagaagctggattatttgattgaaaaccaatactacgaagaggaattcttaagcctttattcttttgaagacattaaagaagtgtttaagacagcttacgctaagaagtttcgttttccttccttcatgagtgcgtttaaattctataatgactatgctttgaaaacgaatgacaagaaaaaaatcctcgagcgttatgaggaccggatctcaattgttgcgctgttcttcgcaaatggcgacactgagaaagcaaaagaatatgtgaatctgatgatcaatcaggaatatcagccgagcacaccgacatttttgaatgccggcagaaaacgccgcggagaactggtgagctgtttcttgctcgaagtcaatgattccttaaacgatatttcacgggcgatcgatatttccatgcagctttctaaactgggcggcggtgtttctcttaacctgtccaagctccgcgcgaaaggtgaagcgattaaagatgttgaaaacgccacaaaaggtgttgtaggcgtcatgaagcttcttgataacgcgttccgttacgctgaccaaatgggccaaagacaaggctctggcgcggcgtacttaaacattttccaccgcgatatcaatgactttcttgatacgaaaaagatttctgcggatgaagatgtgcgcgtcaaaacgctttctatcggtgtcgtcattccggataagttcgttgagcttgcacgtgaggacaaagcggcttatgtattctatccgcacacgatttataaagaatacggccagcatatggatgagatggacatgacggcgatgtatgaggagcttgttgacaacccgcgtgtcaaaaaagaaaaagtgaatgcgcgcaaattgcttgaaaagcttgccgttctccgttctgagtcaggttatccgtacattatgttccaggacaacgtaaacaaagagcatgcgaataaccacgtatcaaaagtgaaattctcgaacctttgctctgaagtgcttcaggcgtcacaggtttcggcttacacagattatgacgaggaagacgaaatcggcctggacatttcctgcaaccttggttcattaaatattttgaatgtcatgaaacataaatcgattgagcgcacggtgaaactcgcgacggattccctgactcatgtatctgagacgacggatatccgcaacgcgccggcagtcagacgcgcgaacaaagcgatgaagtcgatcggtttaggcgccatgaaccttcacggctacctggcccaaaacggcatcgcttatgaaagcccggaagcaagagattttgcgaatacgttctttatgatggtgaacttttattccatccagcgttcagctgagcttgcgaaagaaaaaggcgaaacgtttgagcattacgaaggctccacttatgcaacgggagaatatttcaataaatacatcgaaaaagagttctcaccggcatacgaaaaaatcgctgcgctctttgaaggcatgcacatcccgacaatcgaagactggaaagagctgaaggcgtttgtcgccgaaaacggcatgtaccacagctacagactgtgcatcgcgccgacaggctccatttcctacgtccaatccagcacggcgtccgttatgccgatcatggaacggatcgaagaaagaacatacggaaattcaaaaacgtattacccgatgccggggttagcgtctaataactggttcttctacaaagaagcttatgatatggacatgttcaaagtggtggatatgatcgcgacaatccagcagcatatcgatcagggaatcagctttaccctgtttttgaaagatacgatgacaactcgtgatctgaaccgtattgatctgtatgcccaccatagaggcatcaaaaccatttactatgcaagaacgaaagataccgggcaggacagctgtctttcttgtgtcgtttgattaaaggagagttaacagtgacaaaaatttatgacgcagcaaactggtcaaagcatgaagatgatttcacccaaatgttctacaaccaaaacgtaaagcagttttggcttccggaagagatcgcattaaacggcgatcttcttacttggaagtatttgggtaaaaatgagcaggatacgtacatgaaggtgctcgccggcctgacactgcttgatacagagcaggggaacacaggcatgccgattgtggccgagcacgtcgaaggccatcagcgaaaagcggttcttaatttcatggcgatgatggaaaacgcggtgcacgcaaaatcatattcaaatatttttatgacgcttgctccgactgaaacgatcaacgaagtatttgaatgggtaaagcagaataaatatctgcagaaaaaagcgcaaatgattgtcgggctttacaaagccattcaaaaagatgatgaaatttcactgttcaaagcgatggttgcttctgtctatctggaaagcttccttttttacagcggtttctattatccgttatatttttacggacagggaaaactgatgcaaagcggtgagatcatcaacctgattcttcgtgatgaagcgatccacggtgtatatgtcggactgctggcccaggaaatattcaataaacaaacagaagcgaaaaaagcggaacttcgcgaatttgcggttgagcttttagaagagctttatcacaatgagcttgaatatacagaggatctctacgaccaagtcgggctgtctcatgacgtaaagaaattcatccgctataacgccaataaagctttgatgaacttagggttcgatccttactttgaagaagaggatattaatccgattgtattaaacggattaaacaccaaaacaaaatcacatgatttcttctccatgaaagggaacggctacaaaaaggcgacggtagaaccgattaaggacgaagatttttattttggccaagatgaagagcagatataatatctgctcttttggcttgagtggagaggtaagacaggaggaacgggcatgaataaaatggatgaaatcatcttggctgcaccgcggagtgacgtctttcaaaacgaaatgctgacatttcagggagtcaacagcgaggatgaacgtatcataaaaattatggctcaaattgaggcgcatttttttgaaatcagaagaggcgacgcggaagaggacccgcgatttaaacagccgattccgtatgtcgtcatccgccgcgatgatgaggtatttgtgtatgaacggctcgcgggcggaggggaatcgcgcctccataataagctttctctcggcttcggcggacacatgaaccctatggaaggggcggcttcatttttggaagtgctgaaacagaacaccgaccgggagctggcggaagaattgtacattcgcgaggaggacaaacaaaacattgtcacactcggcctgatcaatgatgatgaaaacgatgtagggaaggtgcatatcggcatcctttctgcgctccagttagcgcctgcagcacaagtcgaagtgaaagaaaaagatcaaatcgccgggcgctggatgaaactgagcgaactgaaagaggaaaatgtgtatcatcgtcttgaagcttggtctcggtttgtcgccgatatacttcaataacaaaaaacccccgttcgtcccaaaaagggagagcaggggttttttcatttagtcttgcacaatgaaggcatcaaatccggctttttcggcccgcgctgccaacgcttcagcataatctctgaaagagaatgcgccgatctgcactttaaataagccgccttttggaagcacaatcgcgtcaaaacctttagacaccgcatcggcggcaagcgcatcagcatttgctttcacgttgaatgcgccgatttgcactttatataagtcagcctttttttttagaccgaaagcttgctccaagcccttggcatgtcctcttgcaaggctttcaataaaactggctgttttcagtttgtttgcatcagctgacgtatcaacaaaaccattctccgtcaaaatcgccggcatccttgtctcccgcagcacatggaagttggctgttttttttccgcggtcattaaaacccgatgcttgaattacttgcgtgtggacggctgattggtaagtcgaggtcggcgctccgacaccggggtaaatatagctttcgaatccggttccgcctcctgagttaatatgaatggataaaaaataatctgcgccccagctgttggcggcatccgttctttccgtcaggctgaccgtcttatcgcttgtcctgctcatcgtgacagaaactccttcatactcattcgtcagaatcgtgcgcaaagccagtgcgatctccagcgtgaccgctttttcctgaagtccgtttccggttgcacctgaatcagttccgccatgaccggggtctataaaaattttaaccattctccatcacctcattacagcatatgatgatattcaaaaggtgcttgtacggctgtcattcatgaaaaaaatgagaaatacacccaacatttcccggaaaataaaaataaatggtttgtcctcccgtttttgctgaatacaataagaaatgaaaaatatttctcgggaaagcgcaggattcaacatcattcccgaagagaacggaaaaagtgacagataaagaggaaaacgggcctcatgatgataggcggatgtcacagaaccgcttcatcatgagtaagataaagagagaacagagaggtgagcatgttggagcgcgctgtaacctataaaaataacggacaaattaacatcattcttaatggccaaaagcaagtgctgacaaatgcagaagctgaggcggaatatcaggccgccctgcaaaaaaatgaagccaagcacagcattctgaaagaaattgaaaaagaaatgaacacattagtgggtatggaagaaatgaaacgcaacattaaagaaatttacgcgtggatattcgtcaaccaaaaacgggccgaacaagggctgaaagtcggaaaacaagctcttcatatgatgttcaaagggaaccccggcaccgggaaaaccaccgtcgcgagactgatcggcaagcttttcttcgagatgaacgttctttccaaaggacatctgatcgaagcggaacgtgccgatctcgtcggtgaatacatcggacacacggcgcaaaaaacgagagatctgattaaaaaatcgcttgggggcattttattcattgatgaagcatactcacttgcaagaggcggagaaaaggatttcggtaaagaggcgattgatacgcttgtcaaacatatggaagacaaacagcatgaatttattctgatcctggcagggtactcgagagaaatgacacatttcctgtcattaaatcccggtctgcaatcgcgcttccctatcagcatcgattttccggattactctgtcactcagctgatggacatcgcaaagcgcatgatagcagagcgggagtatcaattaagccaggaagccgagtggaagttaaaagattacttaatgacagtgaaaagcacgacaagccccattaaattcagcaacgggcgctttgtcagaaacgtgattgaaaaatcgatccgcgctcaggccatgagacttttaatgggagaccaatacttgaaaaacgatttaatgacgatcaagagccaggatttacttataaaagatgaggcggcagctcacgaatagacctctcagccggtttgaggggtctcttttttatttctctctttaaaacccgccggatgtgtggtatacgccctgcgggtttggtatgatagtactactgcccaatacgacacagaaaggaacatccatttgaacgaacaggaaggaaaaaaagaaacggtcattttggtcggctgccagcttccgcacatgacagatgagcactttgaacattccatggaagagcttgcttcattgacaaaaacggctgacggaacggtgctgacccggattacgcaaaaacggaacagagcggatgccgctacatacataggcaaggggaaagtagacgagctgaaggcgctgtgtgaagagcttgaagcggatctggttatttttaatgatgaactgtcaccgagccagcttaaatcactcgccactgcaattgaagcgaagatcatcgaccgcacgcagcttattttggatatattcgcaaaaagggcgaagacgagagaaggaaagcttcagatcgaattggcccagcttcaatacgcgctgccgcgtctgagcggacaaggaatcaatctctcaagacaaggcggcggaatcgggacgagagggcccggtgagacaaagcttgaaacagaccggcgccacattagaaaccgcatacacgaaattaacgtgcagctgtcaacggttatccgccacagaagccgttatcgggagagacgcaaaaagaacggcgtgcttcaggctgcactcgtcggttataccaatgcaggaaaatcaacgtggttcaatcaattaacaagctcagacagctatgaagaagatctgctgtttgcaacacttgatccgatgacgagaaagatggcgctcccaagcggctacagcgtccttttgtctgatacggtcggcttcattcaggatctgccgacgacgctgattgccgctttccgttcaacgcttgaggaagtgaaggaagcagacttgatcattcatgtcattgattcatccaatgaagattatgccgggcatgaacagactgtcctcggactgttaaaagagcttgaggcagatgatattccggtgctgaccgcttataacaaacgtgatgagacacttcctgacttcatcccgacagcgggagaaggccacatcatgatcagcgcccgaatcgccggggatgaagcgaaactaaaagcggaaatcgaagcttatttgcgccgggagctgatgacaccgtatgaagttcatgtgcctgccgccgaaggcaaattgatgtcacgcatcaaatcagagaccatgatcgacagcctttattttaatgaagaaaatgaacgctacgaagtctcaggttatgtacaggaagaacaaagcatactcggagaattgaagaaattcatgtaaggaaggtatacacaacatgtttgacacactgacccacggcgctcttttacaaaaaaccgccgaagaaacagaagcggaaatctccgccgttcataaaagaatagaagaaatcagtgaacggaatgaatggagagtcctgcaaagctacagaaaacataaagtaagcgatacgcattttacgccttcaaccggatacggttatgatgatatcggacgggatacactggagaagatctatgctgatgtgttcggaggagaggagggacttgtgcggccgcaaatcatttccggtacgcatgcgatttcaatcgcgctcttcggcgtgctgagacccggggacgaattgctttatatcacaggcaagccttacgatacactcgaggaaatcgtcggagtaagaggcggggagtattcaggctcgcttaaggaatttcaaatcggatacaatgcagtcgatttaacatcagaaggcagagtggactttgaagcagtccgggctgcaatccggccgaatacaaaagtgatcggcatccagcgttcaaaaggatatgcgaatcgtccatctttcagaataaatgaaattgaagagatgattcgtttcgtaaaggaaatcaaagaggatgtcattgtttttgtggacaattgctacggagaatttgcagaagagcgggaaccctgccacgtcggagcggatcttatggccggctccctgattaaaaacccgggcggcggccttgctaaaacgggcggctatcttgtagggaaagccaagtggattgaggcctgctcttaccggatgacctccccgggaatcggaagtgaggccggtgcttcgctttattcactgcaggaaatgtatcaaggtttctttctcgctccgcatgtagtggcgcaaagcttgaagggagcggtatttaccgcccgttttcttgaaaagctcggctttacgtcaaaccctgcatggaatgcgccgagaacggatctgattcaatcagttgagtttcaggaccctgataagatgatcgctttttgccaggcgatacaatatgcatcaccgattaatgcgcatgtgacgccttatccgagctatatgccgggatatgaagacgatgtcattatggcagcgggcactttcgtacagggagcaagcattgaattatcagcagatggacctatcagaccgccttatgtcgcgtatgtccaaggaggattaacctacgcgcacgtgaaaaatgcgatttgcagcgccgtaaatgctttaatggaaaaagagctgatttagggcgtttgcaattttcaaagaatttgatgttaagattccttacattgtgttgacacaaaatataacatcacctataatgagactaagataagaaaaggaggaaattgagatgagtgataacattcgccgctcaatgcctttatttccaattgggattgtcatgcagttaacagaactttctgcccggcaaattcgatattatgaggaaaatggattgatatttccagcgagaagcgaaggaaatagacgattattttcattccatgatgtagataaactgttagaaatcaaaaatctgattgaacaaggcgtcaatatggcggggatcaaacaaattctggataaggcatctgccgaaccggaagaaaaatccgaaaaaaccgccaaaccgatgaaacacaatctgtctgatgacgaactcagaaagcttctgaaaaacgaactgatgcaggcaggccgtttccagcggggaaatactttccgccaaggtgacatgtcccgattctttcattaatccgttagcaactgttttgctatatacatttaccttttagaggaggagttttacgaaatggcaaagtacacaagagaagacatcgtaaaattagtaaacgaggaaaacgtaaagtatatccgccttcaattcacagacattctcggaacgattaaaaacgtggaaattcctgtgagccagcttgaaaaagcacttgataataaatgcatgttcgacggttcttccatcgaaggtttcgtccgtatcgaagagtctgatatgtacttatatcctgatctgaacacatttgtaatcttcccgtggacggctgaaaaaggtaaagtagcacgcttcatctgtgacatttacaatccggacggcacgccgttcgaaggtgacccgcgtaacaacctcaaacggattctgaaagaaatgaaagaactcggtttcagcgatttcaatcttggacctgagcctgaattcttcctgtttaaattagatgaaaaaggcgaaccgacgcttgaattgaacgataaaggcggatacttcgacctggctccgactgacttgggagaaaactgccgccgcgatatcgtgcttgagcttgaagaaatgggctttgaaatcgaagcatctcaccatgaagttgctcctggtcagcacgaaatcgattttaaatatgccggtgccatccgttcttgtgacgacatccaaactttcaaactggttgtcaaaacgatcgcccgcaaacacggtctgcatgcgacattcatgccaaaaccgctgttcggcgtaaacggttccggtatgcactgcaacctatcactctttaaagataacgttaacgcattctttgataaagacgctgatcttcagctgagtgaaacagcaaaacatttcattgccggtatcgtaaaacacgcgacaagctttacggctgtcacaaacccgacagtgaactcttacaaacgccttgttccgggctatgaagcaccttgctacgtggcatggagcgcgcaaaacagaagcccgctgatccgtatcccggcttcccgcggcatcagcacgcgtgttgaagtccgcagcgtagacccggcggcaaacccgtacctggcgttaagcgtattgcttgcagcaggccttgacggaatcaaaaacaaacttgaagcaccggctccgattgaccgcaacatctacgtcatgagcaaagaagagcgcatggaaaacggcatcgtagatcttccggcgacactggcggaagctctcgacgaattcaaatcaaacgaagtcatggttgcagcgctcggcgagcacctgttcgaacacttcattgaagcaaaagaaatcgaatgggatatgttccgcacacaggttcatccgtgggagcgcgaacaatacatgtctcagtattaatctctcaatcccttggcactattggtgtcaggggattttttaagttttggtcaaaaggttaagaggtcgatattttggtccttgaccaaaaaaaatgaagttatgaatctaactccataattgaggacacgtatttattgtaatcccttattcggtttaggatggaggctaaatgaagccaattatgctctaaaattgaaccggccatttttattttcaaaaagcaggagcaggaaattcatcaattttgatacgaagtaaactataaggtttctgtcgtaagtcttctccataatgaaaactagcctgccgatgtaattggttcacgatgacgtataagtatccatccggaccaatcgaaaaagtatccggccataaaattctcggatcatgtgcgatggtttccattgtgccattcggcagcatctttcgaatactattgttctcgtaatctccggcataaacggctccttttgcatctgtaatcattccatcagacgcgcctttttctccccaatacgccacatgataaagtaaatccatgtccgatatatttctatctctcagggcttctgttgagatagagaacaaatggcggctggtcaggggacaaaaaaataatacctttccgtcgggagagatcgcaataccgtcggatgccagcctaaatggggaagttgaaccatccttgttacgattcatcaaaattttgccttctactttcggtataaaagaggaatccggtgaagttggatttgctccatttaaccgtctaaatgcgtttccggtttctaaatcaacgacgataatagctcctggtcctttggaagaagaatccgttatataggcataacctgcagttccgacacgaaaatcaaatcggacatcattcaggtaggttgttggaaggacaacatcttctgtaaaggtatacactcttctgattgtattggtttttaaatcaacagcgactaattttgccccgcctttaattggttcagaaaaattgggcgccgctgtatctagtatccaaagcgttcctcttccatcagcaactacactttggacactgatgaaagtcattttgatattctcaaagttaaccaaattggtttgtgaatcaggataaggctgcaatttatctccaattatttccgctgccgtaaatttaacatcgtctccccatttcggaaaacaaatgaatatacgaccggtttctgagacagtaacaccggtaggcatagctccataaaatgcataaaccagttctaaatcaccaaaatatttttcaaaaggcagcataggtttcataatatcctcctcaaccaattaaacgggatatcacttatatatgattcgcattttttcaagtgcatgtttcttaataagtttttctaaacaaaagatgatggaagtgcttatcatttaataaatcagtcaggtgacacatagggtttttacttaacgtctgtcgaaggagccggcaattacaacatggtatgtcctttgatcggttttaaattttctgaaaaaagagttgaaaaagcagaaaagattttataatatgaaatcaagttagtttgttcgatcaacaaactaataaaccgctttaattgtccttcatgtaaaggtcttaaatggaaggggataagaggctcgatttaattggaggtatatataaaacgaaagccaagcttttatcctgttcactacgatgaaagtgctctgtgaaagtaaactgctatcattttttgaaagcgcttttataaagacctcactggccgataaaattgaagaaatgttataccattcatcatgttccttatgtaaaggatcgaaaaggggaggaaatcatgctcagtgaaaatgtaaagaagatcagcatggttgaaaaagttggatatgcgtctggagattttgcatgtaatttaatttatgcaacagtgtctacttatcttttgttcttctatacagatatatttggtttaccggcagcaacagccggtacgatgtttttagtggttagaatcatcgacgctctcgctgatccttttattggaacgatagtagacagaacaaatagcaggtttggacgcttcagaccgtatcttttattcggagcttttccatttgtcatactggcaatactctgttttacaaccccggatttttcggatattgggaaattaatatatgcctatatcacctatgtcggtttatcgcttacatacacaatgataaacgtgccatatggcgcgttaacctctgcaatgacccgaaataatcaagaagttgttagtataacgtctgtccgtatgttatttgcgaatcttgggggacttgtcgttgcattttttgttcccttactggctgcttatttaagcgatacgtccggcagcgaatctcttggctggcagctaaccatgggtattatgggagttataggcgggtgccttttaatcttttgttttaaaagcacaaaagagcgtgtcacgcttcaaaaatctgaagaaaaaattaaattatcggatatatttgagcaatttcgtgttaatcggcctctagttgtactaagtattttttttattattatttttggagtgaattcaatcagtaattcggttggcatctattacgtaacgtataatttagaaagagcggatttagtgaagtggtacggtttgttgggaagtttgcctgctttggtcattttaccgtttattccaaagcttcatcaattattagggaagaagaaattactaaactatgcattattactgaatatgatcggcctcttagctttactgtttgttccgccaagtaatgtattcctgatactttcctttcgattgctggccgctgcaggaagtctcactgccgggggatatatgtgggcgcttattcctgaaacaatcgaatatggagagtataagaccgggaaaagaatgggcggtctcatatacgctattatcggatttttctttaaattcggcatggccttgggaggggttgtaccgggtttggttctagatcagtttggatatgtggcaaatcaggcgcaaacgccggaggcattgacgggaattttaattacagcaaccattattcccgtgttcttactggttctggccatgattgatattaatttctataacttagatgagaaaaaatataaaaacatggttcgagaattagagaatagagacaaagtttatttggatcatattgacgatttcaaagcttaaaacatgatagtcaacagaaaatagctgaggaggcgttctgcatgaagattatcaatccagtacttaaaggattcaaccccgatccgagtatttgcagagtgggagaggattattatatcgctgtatctacatttgagtggtttccgggagtccagatacaccattcaaaagatttagtcaattggcacttagttgcacatccattacagagagtttcgcaattagacatgaaaggaaatcctaattcaggcggggtctgggcgccatgtttaagttacagcgacggaaagttttggctgatctatacggatgttaaggtcgtagatggcgcttggaaagattgccacaattatttagtgacttgtgacacgattgatggtgattggggggagccgatcacattaaacagctcggggtttgatgcttctttgttccatgatacggatggaaaaaaatatttattaaatatgttatgggatcagcgtattgatcggcactcctttggaggcattgtcatgcaggaatattctgataaggagcaaaaactgatcggtaaaccgaaagtgatatttaaaggaactgaaagaaagctgacggaagcgccgcacctttatcatatcgggaactattattatttattaaccgcagaaggaggaacgcggttcgaacacgctgctacaattgcccgttctgcaaatatcgaggggccatatgaagttcatcccgataatccaatcttaacgtcatggcatgatccaggaaacccattgcaaaaatgcgggcatgcatccattgttcacacacatacaggcgagtggtatttagctcatttaacgggacgtcccattcacccggacgatgattcaatttttcagcagcgaggatattgtcctttgggcagagaaacagctattcaaaagctctattggaaagatggctggccttatgtagaaggcggaaaagaagggagcttggaggtggatgcgtcttctatacctgaaaccatatttgaagacacgtatccggaagttgatgaatttgaggatgcgacattaaatattaattttcaaacgttaagaatcccttttacggagaaattaggttcattaactcaagcgccaaatcatttacgattatacggccatgaatccttaacttcgacatttactcaggcatttgtagccagacgctggcaaagtctccattttgaagcggaaacggctgttgcgttttatccggaaaattttcagcaagccgctggtttggtgaactattacaatacagagaactggacggctcttcaagtcacgcatgatgaagaacttggccgtattcttgaattaacgatatgtgataacttctctttttcacaaccgttaaaaaataaaattgtgattcctcgtgaagtcaagtacgtctatttaaaagtgaatattgaaaacgaaaaatattattatttctattcatttaacaaagaagattggtacaaaatcgatattgcattggaatcaaaaaaattatcagatgattacatccgcggcgggggattctttacaggagcttttgtagggatgcaatgccaagatacgagcggaaatcatattccggccgacttcagatatttccgttataaagaaaaatgaatgtccgcatgaaaaaggagctttctattttggaactcctttttcatattagaaaatgcccgtgtggaaaaacacgtcagaaatgctcccattcaggatgaaaataacaaaacaaaaaacccatctttaaagatgagcgtaaaacatagaagtttgtacatttcagttatgaaccatgtcgagaaaatgatcaatcacaatagaggacattcccaatgccggtgcgttttttcctaggatagatggtaataattcatagctattgtctaggtgggaataaaccctggacgatacttcgcttttaattgaatgtaaaactataggatgcgattcgatgatgctgtttcttaaaatgatggcttgcggattaaatgtatttaaaatattggtcaggcctatccctaaatagaatccaaaattctgtaatgcatgtaaagttccaatatcattcagatgggcgaggtctatgatatcttgagtggacacttttttctcttttgtctgaagagatgttaataaagccttttcggaagcatacaattcccagcagcctcggtttccgcagctgcatttcggaccattaaagtctattgtcatatgtcccatttctccagagaatccgcttacccctctgtataaatcattgtttataataacgccgattcctatccctgtaccgatacttgcataaatcatgttatcgtgatttttggcagcaccaaatactttttctccatatgcgccggcatttgcctcattttcaataaaaacgggcacattgaacttcttttggatgaaagattttaagtcaatatctctccagttggagttcggagcgaaaacaattttttgatttttatcaattaacccgggaacgcatatgcctataccaataagcccgtacggagattgcggcatatttgcaataaagtgaagaatcatctcaattaaaatatctttcgttatttcaggagagctgcattccaaatggtggtgttgatcaaggacgatcgtcccttcaagatctgttaaaatgccattaacataatccacgccgacatctattcctacggagtatcctgcttttctattaaaaacaagcatgacaggtcttctgccgccgcttgattgtccctgaccgatttcaaatacaagattttctttcattaatgtgtttacctgtgatgaaacagttgatttatttaatccggtcatttcagataattttgctcttgaaataggagaattcttaagtatttcgtttagtaataacttttggttaacttttttgacaaaggcttgatcagcgatatccacttcatccactccgtttgtataatctttaaattaagttgaacgttctgtgttatcgtgcgaaacgcagtacatagcgaatccaacctttattatatctaatgtgttcgtaaaaaactaaaaaaaatattgaaaatactgatgaggttatataagatgaaaataagttagtttgtttaggcaacaaactaatatataacatgacataaaatcatctgtattcgaatcatcaagtttagaatttatttttaagggggaaatcacacatggctcactctcattccggttcagtcaactattttgaaagcgtaaacaaagtgatttacgaagggaaagaatccacgaatcctttagcatttaaatactataattctcaagaagtaattggcggaaaaacgatgaaagagcatctgcgattttctattgcctattggcatacatttaccgctgacggcacagacatttttggcgcagctacgatgcagagaccgtgggatcactataaaggcatggatctggcgagagcgagggtagatgcagcgtttgagctgtttgaaaaactggatgcgccattttttgcttttcatgaccgggatatcgcaccggaaggaagtacgttaaaagagacaaatcaaaatctggatataatcgtggacatgataaaagactacatgagaaccagcggcgttaagttattatggaatactgcaaacatgtttacgaatccccgtttcgtccatggtgcggcgacttcttgtaatgcagatgtatttgcgtatgccgcagcccaagtaaaaaaaggattagaaacagcaaaagagcttggcgccgagaactatgtattttggggcggacgtgaagggtacgaaactttgttaaataccgatttaaaatttgagcttgataatatggccagatttatgcatatggcagtggattatgcgaaggaaatcgggtatacagggcagtttttgattgaaccaaaaccaaaagagccgaccacccatcaatatgatacggacgcagcaacaaccattgcctttttaaagcaatacggcttagacaatcattttaaattaaatctcgaagccaatcatgccacattagccgggcatacattcgaacatgaattacgcatggcgagagtgcatggccttctcggctctgttgacgcgaatcagggtgatccgcttttaggatgggacacagatgaatttccgacagatttatattctgcgacattagcaatgtacgaaatcctgcaaaatggcggtcttggaagcgggggattaaactttgacgcaaaggtcaggagatcttcttttgagcctgatgatttactatatgcccatgttgcagggatggatacatttgcaagagggttgaaagccgcccacaaattaatcgaagatcgtgtgtttgaagatgtgattcaacaccgttaccgcagctttactgaagggattggtcttgaaattgcagaaggaagagctgattttaagacacttgagcaatatgcgctgaacaatcagccaattaaaaacgaatcagggagacaggaacggctaaaagcgatattaaaccaatacattttacaggtataaccaaatgaaaaaagaagctccagatcccgcataaaagatgcaggcagccaagttcccggaattgcccgtcatgaagttactgttatggcgggtcatttcaacggaaatctatttagagaggaaggagtgaaaaaatgaagtatgtcattggaatagaccttggaacgagtgctgttaaaaccattttagtcaatcaaaacggcaaggtttgtgcagaaacgtccaaaagttacccgctcatccaagagaaggcgggatatagtgagcaaaatcctgaagactgggtgcagcaaacaattgaagcgttggctgaattgatttcgatatccaacgttcaagccggggatattgacgggattagctattcaggacaaatgcatggattagtactgcttgaccaagatcggcgggtgctgcgtcatgcgattctttggaatgataccagaacgacgcctcaatgcagcaggataaccgagacatttggcaatcatctgcttgatatcacaaaaaatcgtgtccttgaagggtttacattacctaaaatgttatgggtgaaggaacatgagcctgaactttttaacaaaaccgctgtttttctgcttccgaaagactatgtgagattccgcatgactggcgccattcacaccgaatactccgatgcggcgggaacgttacttttacatatgacccgcaaagagtggagcgatgagatttgcaatcaatttggtatttcagcagaaatttgtcctccgcttgtggaatcccatgactgtgtaggatcgctgcttccgagcgttgcggcgaagacagggctgctcgaaaaaacaaaagtgtacgctgggggagcagataatgcttgcggtgctgtcggagccggtattctttcttccggaaaaacgttatgcagcattgggacgtcaggagtcatactttcctgtgaagaagacaaagaaagggattttaaagggaaagtgcacttttttaatcatggaaaaaaggattctttttatacgatgggggtcacgctcgctgcagggtacagcttggactggtttaaaagaacgtttgcgccgaacgaatcgtttgaacaattattgcggggggtggaatctgttccgataggagcaaatggactgctgtacactccttacttagtcggtgaaagaacgccgcatgctgattcatctattcggggaagcttgatcggaatggacggagcccataaaagagagcactttttgagggcgataatggaaggcatcacattctctttatatgaatcaattgagctattccgcgaagcgggaaaatcagttgatacggttgtctctattggcgggggagctaaaaatgaaacgtggcttcaaatgcaggctgatattttcaatacgagggtggttaagttagaaaatgaacaaggtccggccatgggggctgcgatgttagctgccttcggaagcgggtggtttgactctcttgaagaatgtgcagagcagttcattcatgaagcagctgcattttatccaaaagaacaaaatgttcaaaaatataaaacactattcgagttgtataagaacatttacgttcacacaaaagatatcaatacagctttaaagagctttagacaaacctaattttcaggaggtcaaaggaagaacaataaacggccactcattatcaatggccttggttttataaatctgttaacaaatgagaaagccggcattaataaaccatggaatgcaattctttctcccgcgcaatacactaagcgattacagtttagggatatcaaagcagcggcagcgctaatataacttcaaatgtgttaacactattgaaggaaacagataagcattcttgtaagttgtgactgcatcagtctaaactcatatgacgatgaaatgagaagtatacacacaaaacatcccctcacattgcgtgggggatgttttttattattgagattttcctgtttcttgaatccgtggggatagcctttctgcaatggattcacaggtatcactcaacttcaggatttccttagaaaatgaagaaagaacctcgccaaattggccaggttctttttatattgcacaaaaacagacacggtgatataatcagaacacgcgcgctttctgtgttaaaagtcatagttatccatcttatattatgattatatcatgctgaaaagctcttgtcaaatttttttgaaggggagatatagaatgagttctttggttctcggcattcacgaaattgaaaaaacacagcctttgctcgttggaggaaaagggttacatttaggggaattatcaaaaattcaaggaatacaagtaccggaaggattttgtgtcacaaccgccggatatcgaaaagccattgaacaaaacgaaacgttacaagcgctgttgggtcaactgaccatgctgaaagcggagaatcgggatcaaattggtgaagtcagcaaaaaaatccggcaaaccattatggaagcagaaattccttcagatgtagtcaaagcagtcgcttgccatctctcccggttcggcgaagaacatgcctatgccgtacgttctagtgcgacagctgaggatttaccgcatgcctcttttgccggtcaacaagacacctatttaaatattaccggcgtcgatgcgatcttgcagcatatcagtaaatgttgggcgtccctatttacggatcgcgcggtcatttaccgtatgcaaaatgggtttgatcacagccaagtttatttatctgttatcatccaaaggatggtgttcccccaggcttcggggattttatttaccgctgatccgatgaccggaaaccgaaagctgctgtccatcgatgccggttttggacttggtgaagcactggtctccggcttagtatctgccgattgttataaagtacaggacgggcaaatcgtcgataagagaatagaaaccaaaaaaaaggctgtctatgaacgaagagaaggcggaacggaaacacgggagatcgatcttgatcagcaaaagattcaaacactgactgatgaacaaattttacagctggcacgtatcgggagacagatcgaagctcatttcggccagccgcaagatatcgaatggtgtttggaccgcgatactttttatattgtccaaagtcgtccgatcacaacgttataccccgttcctgaagcgaacgatcaagaaaatcacgtctatatctctgtcggtcatcagcaaatgatgacggatcccataaaaccccttggattgtctttttttctgttgacgactgctgcacccatgcgtaaagccggcggaaggctatttgtcgatgtcacacatcaactggcatcccctaatgtcagagaagttttcttaaaaggtatggggcagcacgatccgctcttaaaagacgcacttatgaccataatagagcgagatgatttcattaaaccgatacatgataaaacggcgccgattcccggcaaaggcaatgcagatatgccggatcaagctgaaaacgatcctgcaattgtttctgatttgattaagagcagtcaggcatcgatagaagagttaaaacaaaacatccagacgaaatcaggatctgatttatttcgttttattttggaagatatccaggaattaaagaatattttatttaatccaaaaagttcggtgctgattcgaactgcaatggatgcttcatcatggattaacgaaaaaatgaacgagtggttaggtgaaaaaaacgcagcagatacgctttctcaatctgtacctcataatattacttcagaaatggggcttgcgctattggacgtcgccgatgtgatccgtccttatccagaagtaattgcctatttagagaatgtaaaagatgatcactttttggatgggctggtgaagtttgaaggcgggcgggaaacccatgacgctatctatgcttatctcaacaagtacggaatgcgatgtgccggagaaattgatatcacaagaactcgatggagcgaaaaaccaattgcacttgtccctatgattcttaataatctcaaaaactttgagccaaatgccagccagcggaaatttgagcaagggcggcaggaggcgttgaagaaagaacaagagttattagaccgattgaagcaattaccggacggtgaacaaaaagccagagaaactaaacgaatgatccaaatcatccggaacttcagcggattcagagaatatccaaaatacggcatgatcagccgctacttcgtttataagcaggctttactgaaagaagccgaacaactcgcaaaagcgggggttattcatgaaaaagaagacatatactatctcacttttgaagaacttcaggaagtcgtacgcacaaataaattggattaccaaatcatcagcacacgaaaaggcgagtacaaagtatatgaaaaactatctccgccgcgtgttatcacgtctgacggtgaaatcgttacaggcgagtacaaacgagaaaatctcccggccggagcgattgccgggctgcccgtttcctcgggagtcatagagggcagggcacgggttattttaaacatggaagatgccgatttggaagatggggatatattagttacccctatactgatcccagctggacaccattgtttgtgtccataaaaggcctggtcactgaagttggcggactgatgacccatggagcggttatcgcgcgtgaatacggcttacctgcagttgttggagttgaaaatgcaacccaattgataaaagatgggcagcgaatccgcgttcatggaacagaaggctctattgaaatattataatagcgggtgtgtgcacgtcaccagatatttcctgcatattaactgacaaataccgaacaaaaagaaaagccggaaccttttagaagaggaatccggtttttttatgtgaaaatgatttaatgtgtgaacaccgcattttgtgggcggacccttacaaaaaagattcagtgactaaatctaacgatgacaattttataaaggtgagtaatatcctttttaagttcacaacctctgtaatcctgatgaattaaaaacgccttagttttttaacaactatttaggggttttgttcatgaacaagtctttattccgaattgaattgttcaccttattcttcatagcggcaatattggcgcaggcaggggagaaaactctcccgcttaccagagtgaaaataaaaaatgtttatcttagatagatttttttaaaaagtaaaaacgccataaaacttcttatggcgtctgtccgaactaagggatgcaatgtttgggagacgaatataaatcgtcaatgtgctagaaaaggaatgcagcacctacaatgattaacaaaatgaacagcacaacgatcaatacgaaagaacttccaccgtaatttccaccgtagttccccatattattgccacctcctgttgttaggatagtacataatatgccggacgataaatttcgacatagatttaagtctaaataagaaaaaatggatattaagtctaaaatgaagagcttctaagaatatgaaataatggaaagagagaaatggatgggacggtttgctgtttaaagaggagggatatggctcaacatgcaataaaactgtggatgaaagtggtgagccatgacgttacttcatcatgcagagccacatacgaagaggtacagggaaattatagttaacgaaaatattcatcatttcccgggcaagcgcagtatacgacaaatcaaaacaaatcacaaagggacggaaggtacgatacaaggaggctgcttgcgggtttgtggtgcagataaagtttccgtttcaaaaaggtcatatgtttattcgacactttacgtttattcctgcagaatgcttggaaaagaaagtcggcaaaactgccgactttcctaacggaatttagatctcaacagatctaaagaaaccatcgacactatcaccggtgccgctatcatatttcaggatgtattctcctttttggttaacgctgaattcttgaatgaacgttttccccgcatttagtgtcgtagaggataagagtgtattcccattaggataattaatggtgaatttgaaagatttgctgccgtcattcgctacaaaaactctgatttttcctggagagctgccttgatagttgaatgaaatcttaccggtaccgccagaaaaaggctgacacgcaatatacggagcgtcacatgaccaaccggcaggtttcatgactttatcttgatttggcaaagattttgcagaaacatctgcagcccccattagcggaattaacccaaaagcaagagcgccggcaataattttctttttcattcgtattcctcctcttaatagtgaatgtgatacagctataaatttacaatatttataaaataattccttctttttcaagttgagagaagaagaaaaatttaaagaggacaaataagtgtcacaaattaacaatccatgcactgcagtaaactggtcaaagcatgaagatgattttacgctaatgttttacaaggcgatcttctcactgtgagttaaagaacaagacgattgttaaccctgtgcgggtacgtaacaactgaaagaaagtaaattcccggacaaggagtatttctttaacctgaaacttttataaagcattaacgtattactttataaaggtaaataaggaggcttctgaatgggattaaaaaatttctttaatactgagttaaaatgctctatctgcggaaaaacattaaaatcaggggatgagataacagcttatcttacacttccgagtgagaagaagatgcctgtgggtagaatggacaaagtgttaagcaaacactctgataaggtctgctgtaaaaagtgcagtgagtaggtttttagtgttatgaggaacctctggtgggtttcctcataacagctacgcttcggcaatgaatgacctggaattatattggtatcagggttagtccaggcagtacttgcaaaatgtatgtccgccgaatggtctgtaaagtttcttttctgaactaaatgacaaagtcttattcagtctgggtggggcgctgagcaagaatagagattaaaggctgccgtatcattcccggcagccttaatgattaggaagtaaaatcgataaccatgcggccggtcactttaccttgctccatttcttcaaaaatatcattcacatcttcgatcgggcgttttgtcactttaggtacaactttaccgtccgcagcaaattgaaaagcttccttcaggtcttctctggtacctactaatgaacctactacctgaattccatctaacacaagacgtggaatatctaaatccattttgtccaccggtaaaccgactgcgactacacgggctcctgcttttacaacatcaatcgcttgattgaaaggggttttagagacagccgtgatgaccacagcatcaagccctaaatcgttagtcacttcttttgccttagcgacggggtcttcgtttaaactgtttacaaccgcatcagcgcctaagctcttagcaaaattcaatttttcatcgctaatgtcgaaagcaatcactttagcgttaaagacgttttttgcatattgaacagccaagttgcctaaaccgccgactccaaatacaccgatccattgacctggtttaatttcactgactttaaccgctttataagttgttacacctgcacaagtaatgctgcttgctgctgcaggatccaaattttccggcacctttattgcgtaatcgaccgctacgattgcttcttcagccattgcgccgtcaactgtatagccggcattttttacatcacggcacaaggtttcacggcctgttaagcaatattcgcagcggccgcagctttcaaacatccaggcaatagagacgcggtcgccctttttcaggcttgttacgccttcaccaatctcagtcacaatgcctattccctcatgacctaaagtgacgccggtaacatccccgaaatcagcatttttaacatgcaagtcagtatgacatacaccgcagtattccatcttaactttggcttcaccatgccgcaaaggacgtaattctttttgtacgatcgctatacttttgtcttttgttgctactactgctttcaaatcatacacccctttcaaatattcgcagaaaatttttacttatcttacaatttagcacacgactcttcttttgaaaacccttacatttttgcggacaagtgtctctacaaaaattgagggagctatgcagggaggattctacggatgatttgtcatccgaagggtgtttaaatgggggtttgtcatctccaaatgcacagaatgctttgaatttgcggtcataatctttctatagatatttgacttgcactgcagagaattacgccgtcaggatatgattttacccttagtgaaaagaatttcacgggtgatcatttgaacttgagcgcggctgataaggtgaatggtgatgcaaacagaaatcattacttattggtcacaaaaggagccggctgcggagatgtgtggatttcacggatttgaacacgatgagccggatgcagattggtgagcgatacacagtcaaggtatttccttgaccttttttatgggtatactgataattaaaagtaatcatagtatactaaagttacaataaaagtaacgaaatacaaattttaaggagttgcataaaatcattcttttaaagagaaggggatcaggttggatcagttaataaatcctacgaaacattctttttattttaggctaagtaaacatgactgttataaagttagaacaggaaagtgctccttagatttaactgataaggaatttaatgctttagaaggcgaagagcatgaatatgcattaaaatgcagaagattggctgcgcactacataaaaccggacatgcataaaaaacattcaggaatatatgcaagcgtaaatgcttgcggtcatatttcgtttagtgatggtcagcacaggatgtgtatctgcaaaaggtcaggtgtcgataaattacttattcatttatcaaacaacggagattatatatgtcatatatgccaggacaaaaacaaaaaattaacagttaaagaaaaattgaagcaaaggttttttaaaaaggattcgaataaacttgcaagagaaaatgattttattgatgatgagttttttgattaaaccaatcttttatttcaaatggaggggtacatttgggtatactcaactttttcaagaacaaagttaaaaatgaacaaaatgagaataaaaataataatatgaacactgttggcgttaataacgaaacagagatggtatcgaaaaaagaaaatttcccaatcttgattcaagagacaggcttctcaaggaaatatgaagaaaagtctgcatttttcgagtatatagactttaaggttgcaggaacatcacactatcaaaaagatattaagaaagccatcaagactgaggatgaagacagctttttcttcgatgaaaaatatgatggtatgacaaataaagagattctagaatcaacttttgatgagccgatatttatttatcataatttccttttctcaaattgtgaattgcggttagaagagaacaacaagtacgatccggaagctatagctgtctatgtaaatgattgcaaagtaggacatgttcctcgaaagaattttcaagaaggcaagaaatacatttacgatcagttaaagagtggtataaggcacccgatatcagcaagtttgtatggagggaaatataaagttaaccgcgatgatacaaagattgaaacaggagaaacagattataaaattgaatgtcaaatagtgattaaaacagacaaatagacaataaaactacgatattgtaagtgcgaagtaaatgaacggggcggtgacttgaagctgaattcaacaagattaaagagctatacctacacattggctttttcaagtttgtcgtatggtttgattttcgggctatatatgtttgtatactcgggttttgtgccaattgcattggttactgtagttatcattgctttttacgcattcattacttactttttgtttgctgttcctgtgcaactatggctaagaaagaagcctaaaaagtttagtttggttcatcttttcatttataccgcagtcgcttttttagctgtgttcttgttctggcacataggtaatccgtcaattgatttcacggttttcagaagtttcatttattacataatgagcattgctgctgcgttcatatattggtactgggactctatatttctgagaaattacaatgttcatcggaagtaaagctgatgtttccaaaagaaagcgggtgaggaaaaatggaatacattgagttgaccagggacaatattgatgacaatcatatttgctgtgcgttaggtacgaaacaatatgaggatgcggtaaatgaaaagaagagctggctcaaagatcggatgagtgatggcttggtgttctaccgcctaaacgaacgggccaaagtttttattgaatatttacctgcagaagaagcgtgggtcccggtaagcgcacctaattttatgtttattaattgcctttgggtctcaggtaaatataagaataacggacatgcaaaacacttgttagaaaaatgtgtgtcagatgcaaaatcccgcggtatggatgggatagttcatatagtggggaagaaaaaactcccttatttaagtgataagcatttcttcgagcatatgggatttgctgtgcaagatgaagcagaaccctattttcagttgatgtcactgacgtggaatgaacatgcacatcctcctgtatttaaaaaacaggtgaaaagtaattccgttaatgatgagggaatcacaatattttatacagctcaatgcccatttgcagtcggagtgttaaagcatttaaaggaactgactgaaaagaaaggacttcattttcaggccctgagaataacgtcaaaagatatggcgcaaaaatccccggcagtttggacgactttcagcatgttttataaggggacatttctcactcatgagatgatgagcgtaaataagtttgaaaaaatactcaataagcttttaatggcttaactttgttttattactattgctcgtttttatattcgatactgagggtttttcacgaaaattgttcagtactttacattgcgggcggcaaatgaatgattattgtttttgacaaagatgataacacccatcattatagtaaaaatagattgtgataagttcttcaacaaacgaagaagttcttttcaaaggtcgataacaatgaaacaggagactgcaaatgcaaaaaattgaaacccatcgcttaattttaagaaattttaccgagagagatgcacaaggtctgttggaatattcggcacatccgagagtgaattgttttcttgatgacagaatatctacgttagaagaagctgccgtaaatgttcaaaaaagaagccgagatgactcttatattgcagtttgtttaaaagacagtaatgatctagtcggagaactattttatttaaaagaagagccagatacctattccgtttgttggaatttcaatgcccgttttgaaggggcgggatacgcaagtgaaagtgcgaaggctttctttgagtatctctttatgcaaaaagaagcaagaaggctttatgcatatgttgaagatgataactgcaggtcacaaaaactatgtgagagattaggaatgcgtaaagaaggttattttcttgaatttatttcatttactgcccacgaggatggaacacctaaatatgaaaacacttaccaatacgcattgctaaagaaagaatggttaaaacaaaaacataggtaatagaatttgtggggaaataatctcccctttaccgaaaaaaccctgctgaaagcaggtttttttgtatttaggttacctagtaacgatcaaaaagattcagcttgaaggttgggaaaaacatgaaaatcattatagcaatgttgtaaaattagagagaggatgattgtgacggacattttgcagtttagcgacagaaggtgcaggaagtaatttgaatcagcaatgttcaattcattttgatgaatttaaagaagcgcttgataatcaaaatgtgaaaagcagttcagagtcaagacccattttgcggtgagaccggaaatatgctcttcatcttctgatgttgttcaaagctgacacctcttgatgcttatgtataagaaaataataccattgaaatatatgtataaggttggaaacggaggggatcaaagttggtgcgatcttgtgtaaaagaaaggaccaggatgaatgtgaccagcatccaccctgatcaatggggttcacagtgttctatttcattgtattccaatcggaataatattacaagggtgaaaaagaaataagcggaatgttttcggcttcttctgtctctggagcgggaaacggaaagtgagatgtttgaatgaaaataaatgattatctgaaggaaaggtttccgactttaaaattagtgcccggcatttatcatcaatgggacgtgggacttcatttttctctcggcggcaatatgtatcaatttaatgaaagcggtgctttgaatcttgagtattttcagcttgttcatcatcaaaccgccgcacttttcaatgaactgtttgaacatagcgatgacatgttccttgttgccaacgtatataagcacaaaactcaaggtaatcatccgagaaaattaaaggtttatcagccgtttctgaagtgtaaggatgatttatatcggatccaggtgaagacctgcccctgtccgtttgaagaagatgatgcagaagaatatgaaatgcagcagttttctttattatgtaaacggaaagatctgcgtattccccaattacttaaggcagccgtccacgaagattttccgctgaagccaaggttcgggggctgttccgttgggtatcccgatgttttctttgtgaatatgacaaaagatattattttctttctatatgatgacagagggtgtgaagtcatcgctcttgatgccggaagaataggaaagctttatgatcaatatcacgattggattgaattggactgaaaacgaacacatgaattcgaatccgcttgtgccggctttgttcttgcctagtccggctgcatgagtataatgggcagaattgaagggcgccggaaactttttttcctctcataccggccttctgcatgttaagcttctgtatttattttgaataaattcctatttataaaacggctgaatagaataacataaaagcttttttacacagtgcaggaggagagaaatgtgagggctgaacaccgtgattgtatggaaattggaatttattcatttgcagaattatatcccgatcctctgacagggaaaacagtcagcgcaaagcagcggatagatgaattgatgaagctggcgaaactggctgacgacgcagggcttgatgtattcggggtaggcgagcatcatcgtcttgattatgcggtatcttcgccgccggccatcttatcagcgatttcacagattactgaaaatattaagctgaccagtgccacgactgtattatccaccgcagatcccgtccgtttatttgaggattttgcaacgcttgatctgatttcagacggccgggcggaaatcattgcgggacggggcgcatttttagactcgtttcctcttttcggttatgacgtaggccattataaagaactgtttgaagaacacattgacctttttttaaaattaaattccggggaagaatcggttacctggaaaggacgttaccggccgccgctgcgcgaggcagaaatttctcctcggcctttttgcggaagcattccgctatggttaggtgtttcggggactccggaaagcgcagaacgagccgggcgtgcaggtgcgggtttggcattggctgtactgagcggtgatccgatgtcatctaagccgcttgttgacaaataccgggaagcggcttctaaagccggtcatcctccggaaaatgtgaaggttgccgtgaccggacatatgttcatttcaaaaacgaatgaacaggcaatacaagaattttacccgtatcattcaaattactggtctcacgttcattcatatcacgggatcgatgagcctttaacgaagaaagattttgagcgggcgtccggaaaagaaacagctttatttgtgggaagttcacagcagatcattgaaaaaatcatgcatcaatatgagttgttcgggcatcagcgatttctcgcgcaaatcgatataggaggtatgccgtttaaaaaagccgcggaaaacatcgaacgattagcagcggaagtagcaccggttatccgaaaagaaacccgcaaatccagcgaatgaagttctgagcataaggggcgggccggtttttggcaatcgcggattcgacaacagaatcggcccggctttttctttatgattataaaaaacaaaggggaaagcgcgaacctcattgctttttcctatcaagaaaaggaaggtcatttcatcctctatcgtgaagtgtatataccgaaagggattttattaacaaaaaagggaggatgatgcagtaatgaagggtttggtcaaagctgcagttttaactgttactcttgggattggaggcgctttctattcaagtgatgcatctgcgcacgggtatataaaagagcccgtcagcagagcgtacatgggagctttagagaaacaaacattgggctggacggccgctgcgcagaaatatggctccgtcattgataatcctcagtctgtagaagggccgaaaggatttccggctgcaggtccgccggatggaagaattgcgtctgcaaatgggggatcgggacaaattgacttcggtttagacaagcagactgcagattattgggtaaaacaaaacatccgcggcggttttaacacctttacttggtactacacagctcctcatgcgacatcaaagtggcactattatatcaccaagaaaaactggaatccgaataaacctttgtcaagagatgaatttgaattaatcggaacggtaaaccacgacggttccaaggcagatacgaatctgactcataagatttttgtgccgactgatcgaagcgggtatcatgtcattttgggggtatgggacgttgcggatacttccaatgccttctataacgtcatcgatgtaaaccttacacaataatctatgaattactgatcggctgcatgttcatcggccgatctttttagttttaatgtgtgaatgaaaagggtaaaaacagcagagcgccataaacatttcatttatggcgccgtacgatcatggaggtgctgctgacatggatgcggaggtaagaggattcttaataaccgccgaggaaagaagccccaacgatgattaataaaatgaatagcaccacgattaacgcaaaggagctaccataaccacctgagaatcccatataatctcacctcctaaagaggattaatacatactatgccgaaatgaaaagtttgatagggatgctagtttactttttgaaaaaaggtttcttagtctatatttcctttacatggccatccgttaaaatgagtaaaaggaggaatcgtactgcttcctgtaatagaaacggataggctcatacattgagaagttgcgaagagggtgcgcagttggcttgtttttttaaaaatgaaaatgtaacacgctattaggattggaaccttttgattcaacggaacaggctgaagaaatgattggttggtttcaagagcagcagcatgaaaaaagtggatgtgatgaggaatagagaaaaaagatgcgaaaggcataatcggaaccatgtatcaaaacggactgcctggtgatatacgcgtatactccattccgaatgggaacgtaacgatctaacagaagaacttcaagtgttctgcggtaaataaaaaaagccgatgaaggcttaaaattgattagacgctgtaaagcattctttttgctgcgctttctgcagacggagtttgattgtaagaaacgattccgatcatcactaacaagataatgaaaaccaatatgctccacaacactatttttaaagactttgacatggcataccctcactttgaaagactttaccggggctgcgatcggagcccgcacttcaagtatagtcgttataacggtgaaaaatgtacagtatcccgttatcaaaataaaaacttgcgggcgctgccgcaagttttctctgaattaaggtctgtggaattcaatatgctgattatcacgatcgaaccatcctctgaatgcccaattgatccagcccccgtctcctttgttattaaaggaaccgtcttcgaagacccagattccgtaagtaatgccgtcataaacggctgatccgtaaaattgaacgccgttaaagcggtcttcatattcttgatttaaattgaacaccatgacgttgtacttctgtcctgatgcgtaaaatgttgtttccatgacattttttacccagccggttcggttttgatctgacttaactgcttcagctatgcgatctgcgattccgagaacatctacgtttacgttcagcccggcatcaacacctgctgcttttacgttttggcctgctgtttgggataatttactttctaacggatttgcaacgggtgaaacgtgaggcgcattcgggtgttcagactgactggctgctgaggcactggctgtgaaaggaattgttagagataaagctaagcatgatccgactattgttctggcgattttcatgtctatgacctcctgaggaaattttttaaaattgttgcaaattcatggtatcgcagaaaaattgaccaagcaaagagcagattttctcaaaagtcatgtcattctatttatgttgttttctgtaaatgaaatacttttaatcaggcgaaaagggaagaaaataatagagtctttttatgtattgtgataggatgaccggattttgggtgaaaatagcccggagaaacgtcataataagaaaaacacccgggatttaccgggtgtaaaaagtattgatatgtcaagtcagcagcattttttgcattttcttttataaacaacgatgtaatcataatcaagatgctttttatcttgtttcttctttttcttcttttgtttaggctgctttggctggtgatcataatgtccgttcatatccatacccatgtccatacccatgtccatactcatactcatattcctccttttttcatctgacggtagtattctatgacagaaagcatggatggcttggacaaatgaaacggtatgctgaaaaagaggcatctcattcggtataaaaaacaggattatacccgcccgatagaaaagagagaagatgatcctgatattgagatcctatttgataaccgcaattgcaatgccgtaccctttttcagcgctgtataaggccgtcagtttcaataccttccagccttccgcggctttagtcccgattccgttatgagccgtgatataatctcccgggctgaccgtactgtcgactcgtacgtaatgccggccgttgagtccgacaatatgccattcgtctctggccgcgcgtgcttcatagtcagcttcaagagccggactgcagtccgggttttgtttcggtacgcgtactgtttctcctgtttcttcgtcagtcacattttcgtatatgaaaccgccgaactcatttgtcaaaaagcggctttgccatccgaagcttgcggctcctgagataaaagcggctgtttctgaaatgacgccgagcatataatcaccgacgtgagccggttcaattttttcgcctttcactgtgacgatcgtcccggcgggaatcttctggccggttacactttcaaaatattctccgtaccctgacagggaagaggtgacagctccggcgaacgtaccgtggccgcccgctgaatccagtttccatttgatggactgatgccctccggcaaccgtgtatggttcttccaatgtaatgctttctgatgacagaatcgttctggagactttgccgcccgtaatatggacattgtttgaagcggcgataaatgcccttgaaccttcggaacttgaacctccggaagagctgatgatcgcatttctgtcacctctggccgtaatatcgcctgttcccgcaataacggcgcttgtcgggttgaatgcaaaaccggagctggtcgcgagctgtgcgcctccctttaaattgacggggatctgctcataagtctgtccttttatagatgcggcagcgctgtaaccttccgcttgcaccccgagaatgacagcctgactgttaggggacgtaattccgacggaaccgccgtctccgatcatcgtaccgttcataatatttacgttatattggcctccgccgattgtgatgcctttaggagaagacttgtatatatcaaaatttaaaattttaacataatcggttttattagatccgccggatatattgatgtcaaccccggcttgtgtaaagccgcgtattttaatgccgttgatcgtaatattttgactgcggtattgaagagccacgactggattcccgccatagtcgtatgagggatcaccaatagctgtgaatccgtttacattaacgtttttataggcagagatgaccagcgccctcggggttacaccgtcatagagggcattgaataccggttcaatcgcggtgcaatcggttaaagtaacatcataagccgtcgtgctttcggggtctgaggcctgatgatggccgatatgacgaatatcaaatgaacgtacatcacgatacgaaacatgaccgataatatgaacattttgagaagccggccacaggctgtgcgcctttacctcaatcccgcggatatttccgctcgtatagttatttaaaagccacacatgtttagagccgtcgtcaatttcaatgccgttcgagtttgcgctgccctcagcatgctctgtgccgcgggggtttccggaatggcagttggaaatgaaaatatattcgctgtaatgggtggtaatgccgtcgtctccggcgccgtatgccacacagttatcaatccatatataacggcagccgtctttcgtccattctgtttcaggcaaatgatcgtaagtcggagatgtaatatctataccatgcagacccgcgttaaccgtttcaacattcttaatccagccgtattgcacattagcaaacgttaaacagctggaacactgtcctccggggttcctgactccgcattgacggtcaggattccagtctaaagtcatgttctggacaaaaatattacggtttccattttcgtaatcatcgttagtaatgacccattcgtatgcgggagtgtcctcatgaagcttaagcacggtaatcccttgtccctcaccggaaatagtagtccatgaggggagttttatcccttgaaccaaaaattctcctgcgggaacatttactttgacccggccgttcccgatcgcattccgaaaggcttctgtattgtcccggccgtcagggaccgctccgtaatcctccacattcacttcccgggtgattttattcataagcatttcgtattctgtatcaagccgttcttttaaaagtgaggtgaccattccttccgccgtcacccgggcatctgcgatctcaagattatcatccgttgcggaatgcttaataaaattctgcatccttgctttgagatgctccaattcagagggctgtgcagggcgagactgcaatggggcgtttaaagacggatcaggaaagtttttaaattgaaccattctaaagacacctctttcttttgatataagcgcctgaggcaggggacagaaaagaatcgcgcgccctttaagcgcttattcttcaaattctttattcagaacgaaattccttttgaaaccgaggcgaaattttaaaaaagctctgttgaaaggaacggacatatagctttgcattattgtaattgaagctgtcatgtgaaaatggagggaaaaactgataggaggggtcctcattttaggtttattctcattgtcttcgccgtgcttcctcttcggctgcatatacaccaaaatcagcattcttatcagttaaatggtataatggggcacggattggtcatcaatacgactgaaatagggaagcaaaaggagcagcgaacatgactttacaaatcaaaattaaatattcagatgatacgcaaacgagaatcagtaaaattgaacagggcgattggattgatctgcgggcagctgaacatataacaatcaaaaaaggcgaattcaaacttatcccgcttggagttgcgatggaactgccggaaggatacgaggcccatgtcgttccgcgttcaagtacatataagcatttcgggatcattcagacaaattcaatgggagtcattgatgaatcttataaaggcgacaatgacttctggttttttcctgcattcgcgcttcgggataccgacatttccaagggggagcggatatgccaattcagaatcatgaagaaaatgcctgaagtggagctgatcgaagtagacaagctcgggaacaatgaccgcggcggactgggatcaacaggcacgaaataaaacgaaaaaaagactgcttaacagcagtcttttttttatggagacagcagttacattcaaattttttcggggattcttgaattgggaaatcaaacaaaactaaggagacgggtttcatttttatcatttaagctttccgtctctttgaacagaaagacttttttaggctaaaggatagaggttgttttgatgtttttattcttcaagatgaacggaggttttgtccaacgtatataatattgtgacaaaagtgtaaacaaaagaaaggatgatgttatggcaaaaagggttagaagagtagaccgtaaagcagccggcaaagaggcagagcagaagaaaccgtccaaagtcaccctgttctgccgttcgcttcaaaggctgaagcatttgtattgtaacataaacatacaaatgccatcaataaccaaaaaaggaatttcaattttaattttaccgtttttgcttctgccgttctttcgggctgatgccgcttcagatctttacggcagtttcgaggaattaaagctgaatgaagatccttccgatttttccatttcaacgcgggagcatgacccttctgtcctcatattagctatacacggcggaggcatagagccggggaccagtgagttagccagagaaattgccgaaaaccggagtttatatttatttgaagggttaaaatcagccggtaatgcagctctgcatttgacaagttcgcatttcgatgaaaccaaggccgtgcaaatggtgaaagggcactctaatgtcatttcattgcacggttacggcagtgatgataaaaagataaaaatcggcggtacagacagagaacgggccgaactcttgaccgatgtgctgaaacggcacgggtatcctgccgttcttcttggcacaaatgataaatacgcaggcgtcagtccgaacaaccttgccaatcaatcttcatccggattgagtattcaaatcgaaatgagcaccggcttcagaaaatcactatttgacacctttacgctgaaaagcagagcatccgcacaaaacgggaccttttaccaatttacaaaaacgatttctgattttatcagtgacaattattaataagcacgcttattttgtcggcggggctttttcttttgaaatttatgaaactttaagttcttaagatcgtatacataattgacaggatgaaagaaaagaggtgggcaaatgaaagtgatgatcgggtctatcattcttcttgtcatcatcggattcggtttatggctgatgcttagtccaatctttaaacaagtgggaagcggagccaaaaaattaaaaaagtcatgggaggaagaagatcagcatgagcgaaaataagcgcggaaacacaaaaaaaattctcggcggtgtgattataggtgcagcccttttaattgcgggcgtcacagcgtcactattcattgaaaaaataccgaacggttatgtcggggttgtatactcaccgaatggcggggtaaaatccgacacattggaccaaggctggcacttagtcggattatttaataaagtaacggaatatccggtgcgtatgcagacagtgaataatgaaaatataaaagtggcaacctctgatggtaaaaatatagaaatggatatcgcttacaactatgtcgtgcagcctgataaagtagtcgatctgtttaacaaattcggggcggtagacgtcgaaacgattgaaaatacatatttaaaaacaaggctgtgggatgcggcgcgaaaatcaatcagcaaatactcggttattgacacatacgggcaaaaatctgctgaagccgcggccgatgttcaaaagagatttgctgatgatatgaagagtctcggatttttaattgatgatctgacgcttggcgtaccgaagccggataaagccacacaggaagccatcgatgcaagggtgaagtcttcacaggaacttgaacggacacaaactgaaattaaaatagccgaagccgaagcgaaaaagaaaaaaattgaagcggaagggatcgctgactataacgaaatcattaagaaatcaatgtccgatgaaatgatcaaatataaatggattgaaaaatgggacggaaaaacgccgaaagcgacaggcacagactcactgctgcagctgccgcttgacgatcagaagcaaaagtaaaaagaggaggaggcgattgcctcctttttatgttttttcctgagggtctttttccggcactaattcttcagacgcctcggtttgatagctccatagcgtgctatccgtctctgttgtgtccttataatcttcgggaagtacatattgctgcaaataccggtgaaaaaatgcctcaaaaacagaaatgcaaagtgcagagataaccgctgccgcggcaggagagacattaaacccgccaatgttcatcaggaatatccataatataatgaatgaaattccgaaatcagctgcaacggctgtgaaattgcttgttctcggcagaatcatgcaatcacccgcaaaataagtgattaaacttaagatcactgtaataaacagaacgtttaaaaaggttacttggtacataagatccagaacaatgtacagtaaagcaagtgtgagcgccgttttagaagcgaaagcaattacgtgtttcatttgaaccaccttcgttatttcgtttagtcttcattgtaagcaatccgcaaatttttaaacaggtatatagtggttataaagtaaaatgtgaatagacatcacaggattcacaagttaaaatatgtaaaaagggggatgcaaatgaaaaaatactggatatgtattgctgtttttttattatgttttagcggaatacactcagctaaagcggctaccactgaattcggatcaaaaacaagcttcactttggagggaaacgcaaaagagtttcatattgaaaatccgggtgctgtagctgccgacgattactttttaggctataagttcaccataatgaacaactcttcgtgcggtttaagcatgaaactccagcggatggcgctgaacggaaatttttatacattaagttctaaaaactacagcggcagctggttaaacctcagtgcccaagataaaaaatcaattgatccgtatcacaaatacaggattctggttgaaagttcttcaaacgtctgtggtcccgtctatattaaagggttctacggtgtagaatattatcattttgattgaaaatagatactcgctaaaggcagcgggtttttttatatttatatttaacttattgcactatgtactaaatattcatatataaattttttgacgtgcccgcccaaagaaaagataaaaaagcaaattcatcacgcacaaatatataaaaagttgaaaaatgaatgaaaagtttctcgagggaaacattattagttgacttcaaaagtgcgatgtcggataataagaatgtaagtttttcctccttagcaggttcgtttcttaagccagggcgaatctgctttttttatgcaaaaaaaccccttacagaggggttttttacgataaatgaagtttaatagaattaatggacggctctgaatacgccgatcactttccccaaaatgcttacgttttgcaggataatcggctccatcgtcggattttccggctgcagccgcacataattgtcttctttatagaagcgcttgaccgtcgcttcatcatcttcggtcatagctacgacgatttctccgttattggccgtgttctgctgtttgacaatgacgtaatctttgtcaaaaatgccggcgtcaatcatactttctcccatgatttctaacataaagacatgttcgcccggaggaaccatccggtcaggaagcggaaaatactcgtcgatattttcaacagccgtaatcggaatacccgccgtcactttcccgatgaccggaacgtttacgacctggcttttcggaatatggacttcttcttcatccaatacctcaatcgccctcggtttcgtagggtcccgtctgatcaggccttttgtctccagccgcgccaaatggccgtgcacggttgaactggaagccagtcctactgcttctcctatctctcttacagaaggcggatatcctttcgtttttacctcttctttaataaaacgcaggatatcaagctgcctttttgatagcttcgtcatatttcgcacctcaaaacgtcgattttaagtagattatagcatgattttcctgacagtacaaacataggttcgaaaaaaacgattgacagaaacatttgttcgtatatactgaaagatataaaaagcgaacaaacattcttatcggaggttgtttacatggcgaaagaatctatcatatttgtcgggctgtttactgcgattttaagtgccgctattttacttgtttcatgtgcgggaaatgatcagtccctcagccaatatgttaaaataaaggttcaggacggcgatacactctggtcacttgcagatcatgtagcagaaaagaaacacattaataaagaagatttcattgagtgggtgacggagaataatcatctccagactgctgatataaagcccggagacgaacttattctaccggttaagaagaagcatccggccgtatatcagctggccattgtcaattagagaggaaagagagaaatgaaggcgctcatttatgcccgcgtaagcacaaacaaagaacagcagcaaacgtcattaaaaagacaggaagaggagctcagtgagatcgctgctgcaaacggcatggaagtcgtgaaagtcatttctgagaaagccagcggttacgaaatggaccgcgacggagtatttgaaatgcttgatgaaattaaaaaatcacatattgacgcgatattggtgcaggacgaaacgagattgggaagaggaaacgccaagattgcgcttttgcattgtatttacagggagaacgttaaaatatatacgacggctcataaaggtgaactggagctttccgaagctgattcgatggtacttgaaatcgtcagtattgttgaggaatatcagaggaaaattcacaatatgaaaatccggcggggaatgaaaagagccgtgaaaaacggctacaagcctgaacggaatctgaaaaacagacatgaaaacagcggaaaagaaaaaaaagaggttccggtttcggaaattatcaggctgagagccaacaagcttacctttgcagaaatcgcagcgaccttaagaggattcggctatgacgtgtccaaagccacggttcaccggcggtttcaggaatataccgcagacacagaaggcagctgacgcgcatcagttgtaaaaaagactgcgttttagtagtatataatcaacacgcaccaaaggagcttattatgatttctaaagaaaaaatcgcaagaattaacgaattggctcaaaaagctaaatcaaacacaataacggatgaggaaaaagctgaacagcaaaagcttcgccaggagtatttgaaaggattccgctcctcaatgaaaaatacgttaaagagcgtaaaagtgattgatccggaaggcaacgatgtcacccctgaaaaattaaaaagagaacaacagaaaaataatcttcactaaacagaaagaatacggcaatacgtattcttttttcgtatatactaatatcaggatgtgctttacgacaattttcaacaagtttatctcaaatttaagctgaaagagttgagaaaaagtcagcatcgctttatgatgaaaaggtacaacaataaggaaggggattataatggatacaattgaaaagaaatcagttgccaccattcgtacactatctatagacgcaattgaaaaagcgaattccggacatccgggcatgccgatgggagccgctccgatggcatacacgctgtggacgaaatttatgaatgtaaatccgcagaatccgggctggtttaaccgcgaccgctttgttttatcagcaggccacggttcaatgcttttatacagcatgctgcatttaagcggatatgacctcagcattgaagacttgaaacagttccgtcaatggggaagcaaaacaccgggacatccggagttcgggcatacagccggagtagacgcaacgaccgggccgcttggacaggggattgcaatggcagtgggaatggcaattgcagaacgccatctggctgagacatataaccgtgattcattcaacgtagttgatcattatacatacagtatttgcggagacggcgatttaatggaaggcatttcttccgaagccgcttctcttgcaggccatcttgaattaggccgcctgatcgtattatacgattctaatgacatttccttagacggcgatttagaccgatctttctctgaaaatgtaaagcagcgttttgaagcaatgaactgggaagttctttatgttgaggacggaaacaacatcgctgaattgacggctgcaattgaaaaagcgcgccagaatgataaaaaaccgactttgattgaagtgaaaaccacgatcggtttcggttctccaaaccgtgcgggcacatccggcgttcacggcgctccgttaggactagaagagagcaagctgacaaaagaagcgtatgcttggacgtttgaagaagatttttatgttccggaagaagtatacgggcatttcaatcaagctgtaaaagaagccggctcgaaaaaagaacaggaatggaatgaactgttcgcggcttataaagaaaaatatcctgagcttgctgaacagctgtcactcggcatgaaaggcgagcttcctaaagactgggatcaggaagttcccgtttatgaaaaaggcagcagccttgcttcccgcgcatcttcaggtgaggtactgaacgggatcgccaagaaaattcctttctttgtcgggggatctgctgaccttgcgggttcaaataaaacgacaatcaaaaatggaggagacttcacggccaaagactacgccgggaaaaacttctggttcggtgtccgtgaatttgcgatgggcgctgcattaaacggaatggcgcttcacggcggcctccgcgtattcggcggcacattctttgtattctctgattatttaagacctgccattcgtctggcatcattgatgggactccctgtcacttatgtattcacgcatgacagtattgccgtaggagaagacgggccgactcacgaaccgattgagcagcttgcttctttacgcgcacttcctaacctttctgtgatcagacctgctgacggaaatgaaaccgcagctgcatggaaggttgccgttcaaagccaagatcatccgacagctcttgtattgacacgccaaaacctgccgacgattgatcagcaggctgaagaagcgtatgcgggcgtggaaaaaggggcttataccgtttccaaagcaaaaaccgattcaccggacgcccttcttttagcgacaggctctgaagtcggacttgcgatcgaagctcaagcgaaactggctgaagaaaacattcacgtatctgtagtcagcatgccgagctgggaccgctttgaaaaacaatcggctgagtacaaaaacagcgtgcttcctccgaatgtgacgaaacgtcttgcgatcgaaatgggttcaagcttcggatggggcaaatttaccggtcttgaaggagacgttctcgcaattgaccgtttcggtgcttcagctccgggagaaacaattatgaaagaatacgggtttactgcagaaaacgtagttgaccgcgtgaaaaaacttctaaacaaataacgagacaaaagaggatgagtcaaatcatcctctttttcctgtttatgcgacaaaaatagaaggggcggcgtaacagtaatagacaattctttcttttctccttttgtataatagaaagcaataacgaagcgctgtaaaaggggatgaggaaatggaacgtcattactatacgcacctgataaaggatgagtttgcgaaccactacttcgggcgggaaacggctatgtttgagttgtttcgagactatcattggacagatctgacaccccaggaatatcaaatgacagaaaagcaagttcaatatataacggaaccgattccggtgatacatatgcatcagcggctccagctgcatttaaaccgaatgagttacagccgtttggattccatttaccggcttacactgcccggagaaaagggccgcgccaccttcatgatgaaagacagtttaattgagattgcggcttcgggagattatgaggcggaaacgattttctttgagattctgcgtaaaatcagcccctgttttcttgcaatggatttcaagacacggcgctacgggtggttaaatccggtcagggaaagaaattttgtctaaaaacgaggaaaaagagatgtaaatgttgtataatagcctttggtttagtacactttaaactagacaacatgaaggaggaaataaaatgactttatgggttggcatcctagtgggcgttgtcgcattgctcataggtgttgcactcgggttttttattgctcgtaaatatatgatgagctatttgaaaaagaatccgcctattaatgaacaaatgttacgcatgatgatgatgcaaatgggaatgaaaccttctcaaaagaaaattaatcaaatgatgaaagccatgaataatcaagcgaaataatacgtacagattatgatatagagatacatggttataaaaataaaaaacccggagagggttttttatttttgcgtcatgtttcaccccaactgccggtgtgcagttctttttggtattgtatgagaaggtggtcaagctcctggctgagttctatcgtaatgtttgatgtcattccgtttgtcatgacgattttaagcagctctgcccgttttttttcaatttcatttaatagatgctctctaatcacagggatatatcctttcatacataaatctttcacctgagtcgctattattatatccacatttatactgtttttcaaataagaaggagtataatatctcgatgtcaaattaaattatataagctttttctataaaaagtaatccttctcgggaaagtgttaaaaaaatgaaatgattttgtcataactcgaagggagtgtgtcatcgtgagttttaattactttctgacgtttggggccggatttctgtctttcatttctccatgctgtctgccgttgtaccccgcctttttatcttacataactggtgtcagtatggacgaggtgaaaacagaaaaggtgatgctgcaaaagcgtggcctcgtgcatacactttgttttttgcttggcttctccgtgatttttatcgcattgggatatggaacttcgtttatcggcagtttttttacccaatatcatgaagcgatccgccagtttggcgctatcatgctgattcttttcgggctgattactgccggtgtgtttcagccgaaattcatgatgaaagagcggcgcattcactttaagcgccgtccggaggggtttatcggttcggttctgatcggtcttgcgtttgcagccggctggtcgccgtgcagcgggcctattttaggagccgtgttttcgctggcaaatacaaatccttcttcagcagtgccgtatatgtttttatatgttctcggttttgcgattccttttcttgttctttcattttttattaccagaatgaattggattcgcaagcatcagctgcttatcatgaaaatcggcggcattcttatgattctgatcggagttatgctgttttttaactggatgagctacattctgatcgttctgtcaaatcttttcggaggatttacgggtctgtaacggattaataacttttgaactattatataccctttcgtttttggtacaataagactagttaatgttaaatatgtggaggggaatatgacacgagttttagttgtagatgacgccaagttcatgagggcgaaaatcagagagattctggaaacggcgaattacacagtggccggagaagcggctgacggcgaggaagccctggcagtatatcaaaaaatccgtcccgacctggtgacaatggatattaccatgccggtcaaaaacggtatacaggcgctgcaggatattttagcttttgacccgaaagcccggatcatcatgtgcaccgccatgcggcagcagcggatcgttctggaagcgattgaattaggcgctaaagactttatcgttaaaccgtttgaagcatctaaagtgctggaggccgtaggccgggtaacgggaacgtaaacgtgttctcttttcaaattggttttttttatgtttttggagtatagtatatagtatcaaactccgtgcaagcaaaggaatgataaagatgatgattataatttcatccgttattgcagcggccatggccatttccgtgatgatcgtcaggattaaagcctccgacaagcccgcttcacctaaaaaaataattctcccgccgattttcatgagtacgggagcgcttatgttcctttttccgattttcagagtgacgggcgaagaatttttggaggccattacgctgggcgtgatcttctctatttttctgattaaaacatctaaatttgagattaaaaataatgaaatctatttaaaacggtcaaaagcgtttgtgtttatcctgattggtttgctggttatcagaatcgctatgaaatccattttgagcacgacgattgattacggagctttaagcggaatgttttggattctggctttcggaatgattgttccgtggcgcatcgcgatgtttatgtcttaccgcaaactttcgaatgaactgaagaccgctgatattcagatgaattaaaacctttccgtccgccggaaaggttttttatttgagcagggcctgataaggagtaagatcaatctgtttttcgcggagatgcttttttaaaaattgatgatcacgcttaggagtggccagtatgtaacccctgatgattaaatcacgatttatttgttcagcttcctccgctaaggaaagttcaccgatttttccggcgattttcgctttggctacatcccgaaagagctccggcacgggagcgaccaattcatccaaaaacgccttgtcacccgcattccataagtgcctgcttttttcaatataatagtcctgccaatccagttctgaccggccgtcttctttcggtaagcgttttaaaaattttcggaacataaaaaatccgccgatagacagcaatccgatcatcacgatgacccaaaataaaataaaccacataaaccagccttctagcattgttctatctcctccttactttaaccatattgtaaacgaagacagaatagaagaacacatgaaaaaaagaatagaaaaaatgatagatgtccagtcaattcggttgctagaacatattctatcgtatagtgattctgctatttggccatgggagattcactttgagggtatatgactgatatgaccggacaaaaaagccgcttccattgagggatgaaagcggcttttttatgttatagaggaaattgaaaggaaaatgaggcaggagtctcattaggctccttgttcatggagacggtcagaatatggttggtgaaatcagtgaaaatatgtttgtcattcagataaaaaggaagcaccatttgtttgtttaatgtccgttcaagcgttttaacagagagcataaactcatttcccgaaagagtgacggtgatcgcctgcacctgcttcagggccgtcaggtcggcttcaatgatatactgacggcttgtttcatatagatcgatcggcagcgtctcgtcataccaagcatacgggtcctcgtaaaactgccgcagccattcttccgtatcatcaaattcttcagcgttttttgagtgattcatggaagcattcctccatattaaaaagccttgctataacgtatgcagaagctttaaatgggtgaatggcacaaaaaaacagacaccggggtctgttttacatatcgtggcttgtattatgtttttgtcttgtatggttgcggtttttcacttttttgcttccgctcagcggttccggctggccggggttatggcccttcggagcatttttatgcatatctttactcgtatttttatttgtcatgttaaagcctcctttttaaggtgttccggctattggtttgtttttctttttttattgttctgccgttcttcttccgtcaggacgagctggtcattttctatataacccgcgcctttgccttggcttttcgcatcattcatgccgttaattacatgattggctttccgttttaccatgatcatcacctcaacattaatatggctctttacagcccgttgtatgaggcggaaaatcggacaaaatttaccgaaaatatgctgataagacgatcttattgtatttaataaaaacattgatatttacttatgtatgattttatactaagatgaaattgtgagaaaattgtgatggaatgtgaacattcatctaaagaacgatcttgatcattgaagggggattttggagaatgacaaatcagcaaaaagtcgcaacacaagacgttttccaagcaagaaaaacattttcttcaaatgggaaaacatacaactactattcattaaaagcattggaagacgcaggggtcggcaatgtttcaaaacttccttattctattaaggttcttttggaatccgttttgcgtcaggtagacggacgcgtcattacaaaagagcatgttgaaaatttagcaagatggggtactgctgaattaaaagatatcgatgtgccgtttaaaccgtcacgggttattctgcaggactttaccggcgttccggccgtagttgacctggcatctttaagaaaagccatggcctctgtcggcggagaccctgataaaatcaatcctgaaattccggttgacctggtcattgaccactccgtacaagttgacaaagccggtacggaagatgcgttagccattaatatggacttagaattcgaaagaaatgcagaacgttataaatttttaagctgggcaaagaaagcgtttaacaattatcaggccgttccgcctgcaacaggtatcgttcaccaggtaaaccttgagtttttggcaagcgttgtccatacgaaagaggaagacggagaacttgtgacctatcctgatactttggtgggaactgattcccatacaacaatgattaacggaatcggcgtcctcggctggggtgtcggcggtattgaagcggaagcgggaatgctcggccagccttcatatttccctgttcctgaggtcatcggcgcgaaacttgtcggaaaattgcctaacggaacgacggcgactgacttggcgctgaaagtcactcaagtgctgcgtgaaaaaggcgtagtcaataaatttgttgaattcttcggtcctggtgttgctgagcttccgcttgcggatcgggcgactattgccaatatggcgccggaatacggagcgacttgcggattcttcccggttgacgaggaagcactttcttacctgcgtctgaccggccgtgaagaagagcagatcgatattgtggaagcatactgccgcagcaacggtttattctatacgcctgacgcggaagagccgatttttacagacgttgtggaaattgatctgtcaaaaatcgaagcgaacctttcaggcccgaaacgtccgcaggatttaatcccgctttccgttatgcaggaaacgtttaaaaaacatcttgtcagcccggccggcaaccaaggattcggagcggatgctgctgaagagaacaaagaaatttcatttaaacttaacagcggtgaagatgcggttatgaaaacaggggcgattgcaatcgccgctattacaagctgtacgaatacatcaaacccttatgtattaatcggtgccggattggtagccaaaaaagcggtagaattaggcttgaaagtgccgaattatgtgaagacttcacttgcaccggggtctaaggttgttactggatacttagtcaactcaggtctgcttccttacatgaaggagctcggctttaaccttgtggggtatggctgtacgacatgtatcgggaactccggcccgctttctccagagattgaagaagcggttgctaaaaatgacctcctgatcacttctgtcctgtcgggtaacagaaactttgaaggccggatccacccgcttgtcaaaggaaactaccttgcgtcaccgccgcttgttgtcgcatacgcattggcgggaactgtaaacatcaacctgaaaacggatccgatcggcgtcggaaatgacggacaaaatgtttatttcgatgacatctggccgtccatggatgaaatcaattctctcgtcaaacagactgttacgccggaattattccgcaaagagtatgaaacggtatttgacgacaaccagcgctggaacgaaatcgaaacgacggatgaagcgctgtataagtgggaccaggattccacttacattcaaaacccgccattctttgaggaaatgtctgtagagccgggaaaagttgagcctttaagaggacttcgcgttgtcggcaaattcggcgattccgtgacgactgaccatatttctccggccggagcgatcggaaaagacacaccggcgggcaaatacctgcaggaaaaaggcgtttctcctcgtgactttaactcttacggctcacgccgcggaaaccatgaagtcatgatgagaggaacattcgccaatatccgcattaaaaaccaaatcgcaccgggtacagaaggcggctacacaacacattggcctaccggggaagtgacatctatttatgatgcctgcatgcggtataaagaagataaaacgggtcttgtcgtcctggccggaaaagattacggaatgggctcttcacgtgactgggctgcaaaaggaacaaacctgctcggcatcagaacagtcattgccgaaagctttgaaagaattcacagaagcaacctcgtcttcatgggtgtgctgccgctccagttcaaacagggcgaaaacgcggatacactcggcttaaccggtaaggaagtcatcgaggtggatgttgatgaatctgtacgtccgcgcgacttgctgactgtcagagcaatcagtgaagacggtacggtaaaaacgtttgaagtcgttgtccgttttgacagtgaagtggaaattgattactatcgccacggcggcattttacaaatggtgcttcgcgataaaatgaaacagtagcagaatgaacaaaagagagaaagcagtctgctttctctctttttatgcgggaggcttaagatgcttgcgaaatggctgggcggaatgttacttatcgggttgttagtatatgcgggctggaacatttattccgtgcaaaaaagtccgaaagaagggacagaagaagggatgaaagcccctgactttacacttgatacattgtcaggaaaaagtatctccctatctgattataaaggaaaaaaagtgctcctcaatttctgggcgacgtggtgcaagccgtgccgaatggaaatgccggatatgcaggagctgcagaaagaatatcctgatattgcggtagcagccgttaattttacgtcttctgaaaaaaatatacaggctgtgaaatcatttgctgatcattatcagctgacctttcctattctgattgacaaaagcggaattaacggggatttcaacgtgctttcttatccgacaacatacatattagacgaaaaaggaaccattcagcacattcgcgtaggcacgatgacaaaaaaagaaatgaaagaaaaactggatctcaaatagaggttcagtttttttattgtgaagggcttaggttttgaaaaattggaaaaaatgaatgaaaacacggaggtgagaagattgaaaaaaatgcgaaaacgttcttttcatgaattggttatggaaaataaacgtgagctgatgaccaatacggaatatttgaatcagcttgaagaaaagctggagcagcggttcaaacaaaaataacctttaatttgcagtcatgtttgcacctccttttgcaaaatatactcttaaggagggatgaacatgggcataaacaagaaagacggccagccgcaatacgctccgagccacttagggacaaaacccgttaaatataaacgcaacaaaggggaaaagtttcatgacaagtcaaacggacatccgattgtcatgcagacgaaaggcgaataacatcatcaaaggagagcagacattatgacaaacaatgatcaaaaaccgaatccggatgaccgttccgataacgttgaaaagctgcaggatatggtgcagaatacaattgaaaatatagaagaagcgaaagaatcaatggaatttgcgacagatgaggaaaaacagcgcattcaagaaaagaatgccagacgcaatgaaagcattgaatcgttccgcagtgaaattcaggatgaatcggctgcaagagaaaacggctatcaatcataataaaaaccagggaaacctggtttttttctctttccggctcgttgtgataaaatggggctaatctgataaaaagggagcagagaacgttgcatgtgtcaaaaaaagaaatagaagtgcgttatgcggaaacagatcaaatgggcatcgtctatcatgccaattacttagtctggatggaggtcggcagaacggcgctgattaaggaactcggattcctttacaaggatatggaagatagaggagtgctgtcccctgtattggatatcagcatttcttataaaaagccgctccgctacggtgaaacggctgtcgtacatacttggattgaagaatataacggatttaaaaccgtttacggctaccacatctataatccggatcaagaacttgccatcaaagcgacatcctctcatatatgcgttgataaagagagcttcaaaccgattcagtttcgcaaggcttttcctgattggcatgccgcttacgaaaaggcaaaaaaataaggagcggctgcacttatggcatttggaattacgcgtaaggaactggaaagatggaagcaggatgtatcggaagggaaaatcgcttttttaacgcattactggctggacgaccgctttccggaggctaagaccgtgacgaaggccggttcaagcgatctcaataaactgatcagatggggagcggagtacgggctgaagccggagtggattcaccataaaaatgaatttccccactttgacctgctcggagaaacgcaaagaagcatattagaaaaagaacgtctgactgatcacctaaaaaggttcaggctgtaaaaaaaagaacgcatccgctgcgttcttttttttacacgtaatcaaataccggctcttctgcctgatctgaatatgtgactgacaaatcgtgattatcaaagtaccataagtcgctttcttcaataaaaaaggtaatgccttcaacttccgtgctggtgccgatgttcatcggcaggtcttttaaaatgccgagagaaaagcctttctgaacgttgctgcatcccccgtaacggacaaagaaacggacatggtcgcctgtttccagatcgagctcttctttgtaccaatccagcgcgcctttcgttactttcatgttcatccggaacactccctttttgtttctcatataaagaaattatctctattataaacgcatatggcattttgatgtcaaaattgaagtttcatcaaaaccatttgatcttcggttctgttttgtttataatccgtttgatgtttgccctgtgtctgtagataacaaacgcggtcaagagcgtcactacgattaataaataagggtcttttacaaacagacagtaaataatcgtataaatccctgttaacattgaagacagagaaacaaatttcgtaaggaataaaaatacgaaaaatactgcaaccatcgtaacgaataacagcggagcataaaacagcaggacgccccctgatgtggctacggctttgcctcccttaaactttgcgaacacggggaatacatggccgatcactgctgccacccctgcgagaagaggatgaatggggacgtgcagtaaatatgggagcgccgcggccagggtgccttttaaaatatcggctgcgacgacgacagatcccgctttaacgccaagcgtgcgaaaagcatttgtagcgcccaaattgccgcttccgtgttctctaatatcgatccctttcgcaagtttgcctacgactaaacctgacgggatgctgcctattgcataggccaaaataatcaataaagcaatcaacatctacatttctccttttcaatgtcccttcactctattttaacacgagttgttaccgtctgatgacaagttttttgagaattaagctgacaaatcgctttttttgattccggcgaagcggtcatgtacaatatatcaaaaggagatggtaaagatgcaaaatccttcaaaatcagagattaaagaaattctggaccggagcaaacggatcgcggtcgtcgggctgtcagatcgtcccgaccggacttcttacatggtttccaaagcgatgcaggatgaagggtatgaaattattcccgtcaacccaacgattgatgaggcgcttggcgttaaagccgttgcttcattaaaagacgtggagggaccgattgatatcgtgaatgtgttcagacgctctgagcagcttcccggcgttgctgaagaatttttacagacggacgctcccgttttttgggcgcagcagggccttgcaaatgaagaagcgtatcgcatgattacagacaaaggacggacggctgtaatggatttatgtataaaagtcgcccgcgctgttataaaataggaacaaaaaaggcaaaaatccttggcaaatcaggggtttttgcttttttattgaaagaatactctttgcgtatgatgatgaaacagatacaataaagcatgaacagcttttttagaaacccctttatacaggggtttgcagtctgtttgcgatggccggcataaagctatataatagaaagcgaactcatgttcttatctgccgaaaagggcaccaaaaagatgaaaagccgttcgaatgtatgtcttgcggcctaaaaaacgagccattcgcttaaatatgttgcgaaatcaagcatattggttataattgtgagtccgaggagaattggaccgaagcttgcgcatactgaaaaacaaagacatgaaaacatttaaaaaagagaatgattaagagcaggttttttgaaaggggtttgtacgtttggctagaaaacagcaatttgattacaacgaagatgccatacaggtgcttgaaggcctggaagccgtcagaaaacgaccgggaatgtacatcggttcgacggacgcacgcggcctgcaccatctggtatatgagatcgtcgacaattccgtcgatgaagttcttgccggctacggagatcatattatcgtaacgatacataaggacaacagcatctccgttcaggatagaggacgcggaatgccgaccgggatgcataagctcggaaagccgacgccggaagttattttcaccgtgctgcatgccggggggaaattcggacagggcggctataaaacaagcggcggtctgcatggtgtcggcgcatctgtcgtaaacgcattatcggagtggctgacagttactattgagcgtgacggatatgtctataaacagcggtttgaaaacggcggcaagcccgtgacttcacttgaaaaaatcggaacgaccaaaaaaacgggaacgcttacccattttaaacctgatccgtcaatgttcagctcaacggtttataattttgacacgctgtcagaacgtctgcgcgaatcggctttcttgttaaaaggtttgaaaatagaattaattgatgaacggaaaggcgtaaaagaagtattttattatgagaacggaattgaagcatttgtcgcttatttaaacgaggaaaaagacgctttatgcgaagtggtgtcctttgaaggcgagcatcatgacattgaagtcgatttcgcgtttcagtttaatgacgggtattcagaaaatatgctgtcattcgttaataacgtcagaacaaaggacggcggcacccacgaatcaggagccaaaacggcaatgacaagagcgtttaacgagtatgcgcgaaaggtcgcccttttaaaagagaaagacaagaaccttgaaggcgccgatatcagggaaggtttgtccgcaatcatttccgtccgtatcccggaggaactgctgcaatttgaaggccagacgaaagggaagctcggcacaagtgaggcgagatccgccgcggatgccgtcatttctgagaatcttgcttatttcttggaagaaaaccgcgatacggcaaccctgcttgtcaaaaaagcgattaaagcaagccaggcccgtgaagcggcccgtaaagcgagagaagaagcgagaagcggcaaaaagcgcaaaaaatcagaagcgacgctgagcggaaaactcacaccggccggttccagaaatccggcgaagaatgaattgtatctggtggagggagactctgctggaggctctgcaaaacagggaagagaccggaaattccaagccgtgctgccccttcgcggaaaggtcatcaacacagagaaagcaaagcttgcagacatcttcaaaaatgaagaaatcaatacgattattcatgcgatcggcggcggtgtcggcgcagattttgatatagaggacatcaactatgacaagatcatcatcatgacggacgcggataccgacggcgcgcacattcaagtcttgctgttaacgtttttctaccgctatatgaaacctttaatcgagcacggaaaagttttcatcgcccttccgcctctttacaaagtgagcaaaggaagcggcaagaaagagattattgaatatgcttggtccgacgaagaaatggacggcgttttaaagaaagtcggcaaaggatataccatccagcgctataaaggtctgggagaaatgaacgcagaccagctctgggaaacgacgatgaatcccgaatcgcgaacgctcgtcagagtcaagatcgacgatgcggcacgggtagagcgccgtgtaacgacattaatgggagacaaagtagaaccgagaagaaaatggattgaaaagaatgttgccttcggattagatgaggaaagcaatattttggaaaatgaaaacttgtcggtcgctgaggaggtttaatagtggcacagccagaattatttcatgatttaccgttagaagaagtaatcggcgaccgtttcggacgctacagtaaatacattattcaagacagggcgctgcccgacgctcgtgacggtttaaagccggtgcagcggagaattttatacgccatgcacgcagacggaaatacattcgataaaaatttccgtaaagcggcaaaaacggtcggaaacgttatcggtaattatcatccgcacggtgacagctccgtttatgaagcgatggtgcggatgagccaggattggaaagtgcggaatgtgctgattgagatgcacggcaataacggaagcattgacggtgatccgccggctgccatgcgttatacggaagcgagattatcttctatcgcgtcagagcttttgcgtgatattgataaaaatacggttgaattcgttccgaactttgatgacaccagtaaagagccggttgttttgcccgccatgttccctaacttgcttgttaacggatcaaccgggatttcagcgggctatgcgactgatattccccctcatcatctgggtgaggtcattgatgccgtcattaaacggattgaatctccggattgcactgtcgatgacttgatgcaggtgattaaagggcctgactttccgacaggaggcattattcaaggagtcgacggcattcggaaggcttatgaaaccggtaaaggcaaaattattatccgcggcaaggctgaagtggaatccgtaagaggcggacgggagcagatcgtcattacagaaattccgtttgaagtaaacaaagccaatctcgttaagaaaatggacgaataccgcatagacaaaaaagtcgaaggcatttctgaagtcagggatgaaactgaccgcacggggcttcgggtggtcgttgagttaaagaaagaagccgatgcaaaaggcatcctgaatttcttatataaaaacactgatctgcagacaacatataactttaatatggtcgccatacataaccgccggccgatgctgatgagtcttacggccatcctggatgcgtatatttcccatcagaaggaagtggtgacaaaccgctccgtctttgaattacaaaaagcaaaagagcggcatcacatcgttgaaggactgatgaaggcactgtccgtgttagatgaggtcatagcggtcatccgggcaagcagcgacaagaaagatgcgaaacaaaacttaatttctaaattcgcatttacggagccgcaggccgaagcgatcgtatccttgcagctgtatcgtctgacaaacacggatattacggcgctaaaagaggaagcggaagagctcagcaagaaaattcaggagctcgaagccattttaagtcatgataaaaagctgttaaaagtcattacaagcagcctgaaaaaattgaaaaagacctatgctgacagcagacggtctgtcattgaagaaaagatagaggaaattaaaatcaatcttgaagtcatggttgcctctgaggacgtatatgtgacagtcacaaaagacggctatgtaaaacgaacaagccagcggtcatttgccgcttctaacggccaggatttcggtatgaaggatactgacaggctgattcaccaatttgaaatgaatacaacggatgttcttctgctctttaccaataagggaagctatgtttattgtccggttcaccagcttcccgatatcaggtggaaagacatggggcagcacgtaacgaacatcatcacgattgaccgtgatgaaaccatcgtgaaagctataccggtaaaagaatttgatccatcttcatatttactgttcatgacgaaaaacggtatggtgaagagaactgaaatgacgcattacaaagcgcagcgttactcgaaagcgcttgttgcccttaaccttaaaggggatgatgagctgattgatgttcatgtcacagacggcggcagccagctgtttatcgccacccgcctcgggtacggtttatggttcggtgaagatgaagtaaatgtagtcggtgcccgtgcggccggcgtaaagggcataaatttaaaagacggtgataccgtcgtatcagggcaaatcctgcatgaaacagattcgcttgtcctcgtcacacagcggggagcaatcaaacggatgaacctatctgaattcgaaaaaacatccagggcgaaacgcggtgtcatcatgctgcgtgagctaaaaaagaacccgcatcgggcagtcggcgtatttgcgtgcgctttggccgacatgatcgctgcggaaacagaaaaaggcgagagaatcgaaatcgccgtgaagtccttgcgggcgaatgaccgatacagcaacggctccttctttaccgatgaagatgagacagggccggtaacagatgtatggcgtatccctgcatacgatgtttaagagtaaaaataaaataaaaaacctccgctcattgagcggaggttttactatttagctttcatggctgccgaataagtcagtgatagcgtgaatgacttcgattccctgccatacaaataaattcaatgcagtgaatgaaaacaaccctaaaatcaccattcgtaagataaacaacatgtttaacaacctcctcattttatgttacatagataggcgatgttgaacatgaagctcatcgaaatacgaggactgataaaatttagcgattaaaaagcttttctttcgctgtcttctccgggaagcggggcgtctcctgtctgatatcacaatcagtgagacagaagcggcaaaaagcgccgtcaagatatatgagcccgtcagcgattttttctcatcatcagcattttggccggccttcatttcgtgcatttcctgctggtcggctaccgctttaaaatgatgagcggtatcaaacgcatggggaatggagagcaaatgaaagcttgcaatcgctaaaaataaaatagaagcttttaaaaacaagatttttttcaaatgttctcctcccttcataagtctgaatatttttattataataccctaatttaaatgtaaagtaaacacatttattaaatttaaaaaattattatcctggttaagtatataccattccatccatcttttcatctcttttttcttaaagacctatttgttatgatatgcacgcattccttataacgtgacaacatttttcaggctgtaagataaaaaacggggcatgacagcaaaagatgtgatgaagaaaccgaaacattttcttaaaaaaacttctcaaccactgttgttgtgatataataatacccgttgtgttaaaagatctaacatatacagcaaaaatgacagtaaaagatatgtaaaagggaggttaaacatggaggctttcatcagtgaaatcataaatgttccaaatgattttatttggaagtatcttgtttatattttagtcgggatcggattgtactttacgttccgttttcgctttattcaattccagtacttttttgaaatgttcagaatcgtcggggagaagccgcaaggaaataaaggagtgtcttcaatgcaggcattctttatctcagcagcttctcgtgtcggaaccggaaacttgaccggcgtcgcgctggcgattgcaacaggcggtcccggcgcagtattttggatgtggatcgtagcgattgtcggtatggcttccagctttgtggaaagcaccttggcacagctgtataaagtgcgttccggtgacgaattccgcggcggtccggcatattacatggcaaagggactgggcgcccgctggctcggtattttattcgccgtattgattaccgtttctttcggacttatatttaacgcggtgcagtcaaatacgatttctgtggcgtttgacgaagcattccatgtgaataaaacagttatcgcaatcattttagctgtattaacggctttcattatattcggcggtctgaagcgtgttgtttccgtctcgcaattaatcgttccggttatggcgggaatgtatattctgatcgcgctgtatgtcgtgattgtaaatatttcggcggtacctgagctgcttgttacgattgtgaaaaatgcgttcggtcttgagcagatcgtcggcggaagcttaggaagcatcattattatcggagcgcagcgcggcctgttttcaaacgaagcgggaatgggaagcgcgccgaatgccgcagcagctgcacatgtgtcgcatccggctaagcagggattaattcagaccctcggcgtgttctttgatacgtttatcgtttgtacatcgactgcttttatcattttattgtacagcgttacgcctaaaggcgacggcatccaagtgacgcaagccgcactgcagcaccatctcggcggatgggcgccgacatttattgcgattgcgatgtttttattcgcattcagctcagtcgtcggcaactattactatggtgaaacgaatattgaatttattaaaacaagcaaaacatggcttaatatttaccgcgtattcgtcgtagtgatggtggtatacggatgtttggctgacttccagatcgtctgggacatggcaaacttgtttatgggtctcttggctctcattaacttagtggcaattttactgctgagtaatgtagcctacaagatctataaggattatgccgctcagcgcaaaaaaggtcttgatcccgtattcaaagccgagaatactccggagctcaagcatattgaaacatgggcggaagaagaaggtacaagccctgaacgtaagactgctaactgaggaaacatgcatacaattttcaaaaaacccccttacattttgttgtgaggggttttttatgtgaaaaaccgggttatttttactggaaacagatttttttgaatttattgtatttttctcttgtatatgtaagtgctttcatataaagtttaactaaaccggtttaccaaaccgatttagtcttaaaggaaaggagtattgatgtggcttctgattatggcatttttacgatcggtgatgcgatgatcaccttaaatcccgcaagcacaggacctttgcgttttgttacccattttgaacgaaaagcaggaggagctgaactgaattttgcgattgcatgcgccagattgaacctgcactcaaagtgggtcagcagactggggaaggatgagttcggcagagtgatttatcagtttgccaaaggagaaggaattgatgtgactgacgtctcctttgttgaaggctttcctacatctttaaatgtcaaagagatcagaaatgacggttcaggcaagacgttttattatcgtttcaattcaccaattctgactcttgcaccggaagatataactgagaatatgtttgacggcattcacatcgttcatcttaccggtgtgttcctcgcgcttggtaagaaaaatcttgaaattgctgaaagggtgctttccatcgccaaagcaagaaagattcccgtatcttttgatccgaatatcaggctgaagctgtggacgattgaggaggcacgtgcggcatttcatcaaatctttccgcatactgatattcttctggcgggccgggacgaaatgaaacagctgacaggtataggagaaaatgaagcattagcccggtttgcagagagctattcaatcagtcagcttgtcataaaagacggtgaagcgggttctgcgctgtatcatgatcataagtgggttcacaaagaggctttcccggttgcgcctgtcgacacggtaggagcgggtgacggctttaatgccggctacctgtacagttatctacatggttttgaaccggaaaaacgtctggagtttgcaaatgcagtcggtgcgctcgtcaccacagtttccggtgacaatgaagggcttccctgcctagaagaggttctgtcatttgtaaacaaagagactgtgattgaacggtagcaagcacaacttaaaaagcgggtgaaaaaatgaaagcggttcaagtacggaaagcatttgatctgatggtgacggaatgtgagaaaccgtctgttgtccacgcggatgatgttcttgtcaaggtgaatcgggtcggaatttgcggatcagatttgcatatttatcatgggacaaatccgttagcgtccctgccgagagtaatcggacatgaagtcacaggggaagtcgcaaagaccggttctcatgtccggcgtttcaagccgggtgaccgggtagtgattgaaccgatatcttattgcggaacatgctatgcctgccggaaaggacgtccgaacgtctgcaaagcgctttcggtgttcggcgttcatgaagatggcgggatgcgggaatatatcgtgcttccggaaaagcagctgtatgctgtttcgcccgatctaccctgggaggaagcggtcatggcagaaccatatacgatcggcgcccaggccgtttggagaggccgtgtcgagaaggaagataccgttttgattcaaggagcggggccgatcggaatctgcatattaaaaatggcaaagttcaaaggcgcttccgtcatgataaccgacttgaatgatgaacgcttggccttcgctgaaaaaaacggtgcggatgttaccgtcaacgcgcaaaaagaagatcccgttttgcgggtgaacgaatggacaaaaaatgaaggcgctaatgtcgtcattgatgccgtctgtctcccctcaacgtttgaaacgtcaattgacgcagtgtctccggccggtcatgtggttgtgcttggttttgatgagaggactgccggcatttctcagcttccgatcacaaaaaaggaagtcacgatcaccggttcaagattgcagacgaatcagtttccgtacattacagacttactgaataaaggcctgttaacgcacggcggtcttattacacatacattttcagcagatgacgtccatcgagcatttcagttgatcgaacagcacccgggcaaggtgggaaaagcaatcattacgtttgattaaaggaggagcgagaatgctgcctaagtacgccatttacgaaaaacttctgcatgcacaagtggtggctgtcataaggggacaaaacagccaagaggcgcttgaagtttcaaaagcggccatttcaggaggtatcagcgccattgagcttacatacacaactcctgaagtggaagatgtctttaaggaactccggcatcaagatattcttcttggagccggttctgtaatggataccgaaacagcgagacacgccattttatcaggcgcctcatttatcgtcagctctcattttgtaaaagagatagcatctctatgcaaccagtacagcgtaccgtatcttccgggatgcatgagcgtgtctgatatggctttggcgctcgaagccggatgtgatgtggtaaagctgttccccgctaattcgtttaatccctcatttatcaagtcggtcaacggccctctgccgaatgtccgcattatgccgaccgggggtatctcattaaacagcatgaatgactggctttctgccggagcggtcgcggtcggagtgggaagcgacttgacaaaagcatatcaaaagggcggctatgaagctgccgtatccctcagcaaagaatacgtctgccgaaaaaacgaatatacgggggtgtaacatgaatatcacgtttcgctggtacggccaaggtaatgatacggtgacgcttgaacatgtcagacaaattcccggggtcaaaggcatcgtctgggctcttcaccagaagcccgcgggcgaagtatgggaaaaggaggacattgaagccgaagtcagattcattcaatcctatgggtttcatgcagaggtcgtggaaagcgtgaatgttcatgaagccattaaactcggccatgaagaacgcggacaatatattgagcactataaacagaccattcgcaatctgtccgaattcggcgtgaaagtcatctgttacaatttcatgccgatttttgactggacgcgtactgatatgttccgcgcactggaggatgggtcaactgctttgttttttgaaaaagcgaaagtggaaagtctccctccagaagaactgatccgcacggttgaagaatcttctgatttgacgcttcccgggtgggagccggagaaaatggcccggatcaaggaactgtttgaagcctatcaaacggtcggtgaaaaacagctttgggccaatctagaattctttttacatgaaatccttcctgtagcggaggaacacggcattcaaatggccattcatccggatgatccgccttggtcaatttttggcctgccccgtattatcaccggtgagaaaagttatgaaaagctgcgagagatttcagattcacccgccaactgtattacgttgtgcacgggttcgatgggagcggatcccgccaatgatatggtgaagatcgccaaacactatgcgggagctgcgccgtttgcccatatacgaaatgtgaaaatctgcgataacggtgattttacggaaacttcgcatcttaccagtgatgggtccattgatattatcggtgtggtaaaagaattgcacggccaaggctacaaaggatatgtacggcctgatcacggccgtcatatctggggcgaacaatgccggccgggctatggtttatatgatcgtgccttaggaattatgtacttgagcggactgtgggatgcgttctcgtctcatgagaaagaggtgaagagatgagaccgattcatggacgtttatcaggaagaaccgctgtcataacaggcgggagcggtgttctctgttcagcaatggcaaaggagctttcacggcaggggatgaaaattgcgatcgtcagccggaatgctgataaagcagagcgtgcggcgggcgagattgctgatgctggaggaaccgcggtttctgtaccggctgatgtttcagcccgtgattcgctcgaaaaggcaaaagacgagattatcagccggttcggctctgtcaatcttttaattaacggagccgggggaaaccacgctgatgcgatcactgccaatgagacgtatgaagaggatgagcagagcccatcattttttgatatggacgaaacgggattttccagcgtattttcaagcaactttaccggtgcatttctggcatcgcaagtgtttggaaaagaccttttgaaggcggaatgtcccgcgattattaatatttcttctatgagtgcgtatacaccgatgacaaaggtgcctgcctacagtgcggctaaggcggcggttcagaattttacgatgtggatggctgttcatttcgcgaaaaaagggctgcgggtgaatgccatcgctccgggtttctttttgactgcgcaaaaccgtgagttgttattacaggaagatggaagtctgacagaccgatccaataagattatggcacatacaccgatgaaacgtttcgggaaaccggaagaccttctgggaacgctcctgtggctttcggatgattcatactcaggctttatcaccggggtcaccgttcccgtcgacggaggttttatggcttattcgggagtgtgacagaatccagttccctgtcagattgtaaactatttacttctgacttatactagtgaaaaatgaagacagacggggatgagtctatgaaaaccattacaatttctgatgtggcgaaatatgcaaacgtatctaaaagcaccgtatctcaatttttaaatcagcgctatgactatatgagcgagaaaacgaaacaaaaaatagaagcggccattcatgagctgaactatcagccgaatttcgtcgcccgcagcttaaaacagaaatcaacatttacggtaggtgtggtggtggctaatattcttcacaccttttccactcaggtcatcagggcggtggaagactattttcatgaacaaggatttcatattattgtctgcaatgcggatgatgaaccggaaaaagaaaagaaatatattgaaatgctcagggccaagcaggtggacggaattattatttttccgacgggcgaaaatctctccttatatgaaaagatgaaacgcgatacgtttccggtcgtgtttatggacagaaccattgaagaactcgggattccgacagtgatgcttgataaccatcatgcagccggtcttgccgttgaccggtttatcgagagcggcattaagagaatcgcgattattacgacgtccattattcgggaaatcagtccgagggtagagcggattgaagggtataaaaaggcgcttgacccccacgggatgatggtgcggaacgaatatatcaaaacagccgatgcggctgatatttccaatgttttgtcagagctgttctcacttcaggagcctccgaaagcgatattggcggcaaacgatatcgttcttgttgaggtgctgaagtatatgaaggagcatgatatgacaatcccggataaggcagccgtcatcggaattgatgaagttccttttgcgggtttttttactcctccgattacgacgatcgtccagcctgcggcagaaatggcgcgaaaagcgggaagccttcttctttgccagatacaagaaaaagatagcggtgaaaaacggattcaccgctataaaccggcgcttctggcaaggcaatccggataaccggtttcattacataaaccggtttactccggcaatttaaattatgaaataagagggagggattttatgttctcaaaggatagattccctattcttcttcttttattttcagccggggtgattaactatttagaccgttcagcgctgtctattgcggcgccgttcatacagcaggatctcacattgtctgcaacccaaatggggctgattttcagcagtttttctgtcggatacgctgtgtgtaacttccttggcggtgttgcatctgaccggtacggggctaaattgacattgtgtacggcgatgatcgtttggtctcttttcagcggggcggttgcgcttgctttcggatttgtaagtcttttgattatccgtgttttattcggtatgggcgaggggccgctgtcggctgccataagcaaaatggtcaacaattggtttcctccgtctcagcgcgccacggtcatcggcctgacaaacagcggcacgccgctcggcggagcgatttccggcccgattgtcgggatgattgctgtggcattcagctggaaggtttcctttgtcctgatcatgatcgtcggtttagtctgggcgtttatctggtttaaatttgtcaaagaacggccggcacagacggaagacaccccggcaatgaaagcggcggttcaatcgcatgagcagcatatcccgatgaccttttatttaaaacaaaaaacggttctcttcacggcttttgcctttttcgcctacaattacatcttatttttcttcttaacatggtttccgagctatctggtgaaagaacgcggattaagtattgaatttatgagcgtggtgactgttattccctggattcttggatttatcggtttggcggcaggcggaatgatttctgattatgtatacaaaaaaaccgccggaaaaggggttttgttctcacggaaagtcattcttgtcacttgcctgttcgcttccgctgtactgatcggatttgccggacttgttaccactgccgtaagtgccgttattctcgttgctttatcagtcttctttttatatataacgggctctatctattgggcggtgattcacgatgtggttgatcaaaggaatgtcgggtcagtcggcggctttatgcattttcttgcaaacacggccggtattatcgggcctgctttaaccggctttatcgcggataaaagcggatcattctcgggggcgtttttgcttgcaggcggattagctgttttggcctcggctgcggtaatccgttttgtgcgtccgattatcattcaaacagtttctgaagataaaaaagacacgataccttattcataagtcatcaaagccactgaggctgtcctgccgataacgggatggccttttcgttctcccgcttgatctgttcctatgataatataggaattgtttacaaaagaagggaagaggagggagcatgaaacagaagccgatatatgtcgaaatcaatattgcatctgatatagaaacgctttgggaatatacgcaaaacccgcatcttcataaagaatgggatctgcgtttttctgacattacatatcttcataggctgccagatgaaccgcagagatttctatatgaaacacgaatcggttttgggctgaaggtatccggcacgggcgaatcaataggtgacataaggcctcgcttgtcagaaagagtgtcttcgctcgcttttgcctctgatcatccgctgtcacttataaaagaaggcaggggctactggaagtatacagagcgggataacggacaaacctcatttttgactcaatatcaatatgaaacggcccgcggtctgccgggaagttggatagaccggtttttatttcgtcctctgctaagctgggctaccgcatggagctttgatgcgttgcggctttggatagaacaaaacagacatccgaagatatcggtccgtttcggatttgtctatgtctgtatgtgcctcgtattcagtctgtattggttttttcaaggctttcatgatggctgtgccgatgcagagatcgtgaggggaacgctggagacagggttaggggtattatggctgcttcccatgcggagaaagtggctgattcacgccgggcagtcagtcttcttttgtgtaacggcactgttatattccggcggcggattcttgatttcattaggagtccttacgatagccggcatgattcttaagctcaagctgccgagcgcctggcatacaaaacgaaagagagaagtgaaatgacggattcaatgtatgaaaaaacgattactcattatcaatcactgcacccgatgctgcagaaacggtacagatttgacggatcacgcacgttttgcggagaaggcgttatgtcagaaataaagggaggttcttttcttgtcagaatgcttttaaagaccggtgtttttttcagatgttttttctcagagaggggaaacgatatcccttttactatcgaaaacaaaaacaggcaaaatggcgtggaatggaatcgtacctttttctttaaaggcaaaacgcgtttttttgatgcggtcatggaatatgatgagcgggaaaacagaattcttgattacttcggcaaacctcacatcctactgtctgaactgcatttagaagcgtcttcagacggagggcttgttattacatccggaaggcagtggctcctgataggcggaaagaaaatcccgattccggcatggctgtgcgggaattcaaccgtttatgaggcttatgatgaggaaatgaattgcttcagcataaaggttcatgtgaaaaaccggatactcggcacgcttttctcttaccgggggactttccgggaaacagagggagaaacatgctgaagcgtcatctcatggtaagcgtggtttgctttttgggatttgcggcggctgaagctccgcatatatcagctgctgagacgtttgttttattttccgtgctttttttcgttcccgctgtattctgctttgcttttcggccgtcaaagaccttagagaatgtgtggttacggagttatcctgttgccgctatatgtgcggcgcttgcgcttgtcacaggcttcagcttttttgcctttgtgtggttcatttatacgcttggactggcactgtatgctgtccgccggctgatgaaaacaaatattcacagaacagaagagatgtcagttatggcgggtttcatttatttggccgggggcggattctggttcttcgcatatgtccttgagattcccgtcctgaatttcggcccgcttatcgttctgctgacggcggtgcactttcactattccgcttttctcattccgatctttaacggattgctcggcaggatcatacgggagaaacgcggactttaccggtggagcacagtcattattttgatttcgccggtcctaattgccttggggattacattttcaaagacacttgatgtgattgctgtcgctctgtatcttgcgggtctgtatgtaaatgcatatctcgtctttaaggcgccgtttgttacgaaaacaggcaggatcttgatcaggagttcttcggctgtgttaatgatcacaattgctttttctttgatatattcgtacggtgtctaccgcgaggaggcaacgctcacgatcagccagatgatttggattcacggggccgtcaatgcatttggcgttatcctgccggctttggcggggtggagaatagaaaatcctagaccgttcgatgagaacagtgaaagaacgttcagcagaatttacgggaagggaacgataggcaaagattttttgactgacattcatgcagcaaatgacatccattataccggccttcaggatcagctgagagaactgcattctgaagacttttcaactgaaaagctggcgccggccgttatttccttttatgaaaagacaattgattatgacatcatggcgaaagtgacgtggagcggttggtttcgtccgttcgcgcgcgtgtacgagccgttcagcagaagagcgggacagattcatctgtccatgaatccggattggtatatcatgcacagtgatattataggagttgactctgataaagacggcagaaaaaatgtccgtgcatggatcagaacaaatgaaaagcaggaaaccgtttttactgcgctgtattcagcatacaggtcaaaaggggaaggatacatgaatatctctcttcctctgccgtacggccaaatgacgggcattttaaagccttatgcgcgtaagcagaatcttgttttgacaagcagacggcgaaaaagcggagcgggtgatgaagggatttatctccagacgaaatgggggacgtgtcatcttccgctggcagagacatttcttatttcagcccagagcgaaacaagcctgaaggccgttcatcatatgtggctgttcggactgaaatttttaactgtgcattatcggatcactcatgcttccgcaggtaaccgaagcaaataataagctgcagagccgtctgtttatcaggcggctttttctcattatatgaatagataggaagaagataatgcacccggaagtcaattcatattagaggatgtgatgcgttacgaaagacaaggtgctttttctcattgtcacgtttatcttatggagaaagttttttgtcgttttggaccgggagcggcctcggtcttgcggtctttgcctgtctctcacgattcgtgaaatgaaaacggctgcaaagattcctacattgagcggtatgatgaaggcagccgggcagatggccctgctgaaaatcttgttctttttgtttatgattacgcggaaaaaagcagggaagatgcggcaaagtattatcagacctgattttttatatgcttgcctaaagaaatgatctcattgcgggtaatgaccaaacaagaaattcatttcaagcttgcttttgcgttaggtttttcagctgaatcaaaactagcgctgtaaacatttattgcagttataaatttctcttctttgtctcaataactaaagtatacttggtttatgagacttgtaattcatttctctgtataacttcctagaatatatattatgtaaactagaaattgtgaagagaatatataagtgggtccatattctaacagcatcccctttttgtaaggtaatattaaaaaacctctacgtaaaatcctttgatacattaaacgggcgcccatctttacgcttatacatcgtgctattctgatggccgatgcttaccaccacatatcccacgcttgccaagtctgtacagatcactgtgccccattctggagaaccgcccccgccgcaaacatagaataacaccggatagcgtttttccttcccggagagagcaaggccgtcgtaacattgggtcttgatatctatagagtaagcattcttccgcgcagtgagaagcggctgctcatcaagcatttcgcagacttcaggaaacatgtacgttgatgtagtcttcccttcgctgctgtcggacggatagtacacaaacaccgtcagttctctttttgtatgatctgatgccgtgtactcaaaatccagttgtgtgcggccgacagtatagccgccggttggctctggaaatgcgtcataccttttcattctcttgttcccccttaagtaataaaagtggcgggtgtaaaatacatacattgcgctataaacgcttttcaaaactgtgaaacgattacattatatgtacagtcatatctacttcttcacgtaaacctccatgtattgctgtttaagatgataaaagcggacatcgttgctgatgtccgcctaaagcttaactaattgggttctgttccccaaatcagttttccttgatgatataatgtgatttttttcgttgttttaaatgtatttgattggaaaaaggaataatcgtcgctttgtgcataattactccagtcatcattgtgaagacgaagctgaatattccctgtgcttgctcccggtgacagcgttcctgttttaaaacccagttccagataggtatctgcaccttgcttaggtttatgcagcgtcacaaatttgtgggtcagattgccgcatccaatctgcgcgtagtcacagtcaaagttttggcccttgtttttcgcgttataccagtaacgggcagtgacatcttttaaatcaaccgtcgcattgccgttattttttatgtgaagctgcgggcggatttggttgctgttcacacccccatcccctgctttgtattgtacagaaatgccgttttcctgtgcggggttatcttgtgctggcgtttcagggcgttctttcgttgaatctttgttgccgagaatgttttctcttacgaatgttcctgaagcagttaaatctgtaagcggccagccgcctgttttagatgctcccggctttaacgctgaggatgattcctgcttatcagaaagattccagttcacccagctgatgttcttgctgtcgagataattcagccattcccgcgactggtcaaggaatacaccgccatttccagacgcgtcgcttgttccccattccgtcacgaaaataggcgctcctttactgagtgcatagtttgctttatcccgtaaagattggccgtgtgtgccggcataaaaatgaagcgcgtacatgacgtttgcatcttttagctgatcatcggctgcatcattcacatcttggctccatgtaccggttccgacaatgatgatgttgtctggatcatttttgcggataacggaaatcacttcttccgcatacggtttaatatcacgcttccagttcacatcaccgtttggttcgtttgcaatttcataaatgacgtttggcgtgtttccgtaaagacttgacatttccttaaaaaattcttttgccttctctttatgttggtttgggttgccgtcatttaagatatgccagtcaatgatgacatatatcccaagttcttttgccgcttcaaccgcttcttttactttatttttcacggacggattatcaatataaccgccatctgccgtatacatcgccgcgcggaaaacggttatgccccaatcgtctctcagccattttaagctgtctttattgacaaaatcgccataccattgcaatccatgtgaactgatccctttcaattgtaccgctttgccgtcccggtttacgagctgtgttccttttatgctaagctgcccattcttggctgctggcgtttttgtccctgctgcagatgcctgggaagcctgcaagccgcccattgtcaatactgtaatcaataaacacgtaataaaaatagaaattgaccgtttcatatctgatcttttcctccttcgcattattttggctcttcacttcttatgagctcgaactcattgtaaaaatctttctcatgattgtctatcaacctaatttcttgtttttgggaggtttaaaagcctgtcaatttgctctaactctattgaataagacacacctgacacatatagaacaaagaaaactggactgaatcgggactttacacgttatttttcaatcgaatcgaaaaattaaatgtatttccgacgtagacgctctaaatgtaatgtgatgagtctcaatatggcattgaatcttatgattgctgtaagaagacgagcccttgcccgtccttgttaatttaaggttgatgtaaggttcggattaatacgggttaaggttggagttgtacaataagattgtacttcagtgtgggattcagccagaagaattcccccttcaataaatcatagaggtgaaaaggtttgagagaaaataaaattttgtcttcattatgttacttcagtatattttttgcgccgtttctgtttccgattatcgtctatttcttaagccgggacgatgtgaaagaacatgcgaaaaaatctttgtggacgcatctgattccttatttgatttttggaattggcatcatcgcttcaggtttacttggtatgaatgatatcagacatgccgggcctttcctgcttgcgacttatgctgttacattccttgtggcgatctattttttcatttggaacattgtcaaaggaatcaaagtgttttcggaacaataggaaaaaacggttctgttattaatcagcagaaccgttttttttgtatagccattatgataattgtatatctatcgttgtcccttctcccgcggtgctgtgaatggtgatgtcccctccgtgcttttggataatatcctttgctatggccattccaagaccagagcctgcatgcgtcgttcctgtatttgtccccctgtaatagcgatcaaacactttttccagctcctcttcttctatccctttgccgttgtccttaattgtcacatgagttcgttctttttgttcaagctgtacaacgatcttcacatcgggatcattgtgaacgagggcatttaaaatgagattcgtgaccgctctccgaatcaatatcgcatcaaggttcagcatcagtttttccaggttcgtttgaagctcaatggacttatccgcatatctcgaatcgtttaaaatatcaattaacgtttcccgcagcagcgatacaaggtttacccgttctttatttaacatcacatcgttgtttttcagccttgtcgttaaatttaaatcttccatcacatctttcatatagagcgatttactctcaatgatccgggcgtaatctctgatctgttcgactgtgagatgataattcggatctttgatgatttctgcatagccttgaatagatgctaatggtgttttaatgtcatgagaaatatgactgatccactcttcacgcatttgctctaatttatctttttcttttttgcttaaagatagttgttccgataagtgattgacattatagaacacatctttataaatgcctttggatttcattttgatcgtataatctccattagctaaccgctggattccttgaatgacacggccgagcggttttgtgagctgccggctgaatagatagccaatgagtaacgcgatcaatgcatctattgataataatatgatggttcctgtattgaacttcgtcacaaattccttggtatcatatgagaggacaaattttccgagagagggatttttaaaccctataaagtaactgtactccttgccgtttactttttttccgccggcgtaaatggttgataataattgttcatccttatatttatgtaaatttacaatttcaataggcgtatattttttcttcagtcctttaggttctctatcatgataaacatcctgtccgttttcatctaatatttgaatccatgcattctgctcttttaaagctttttggccctctttgtttactgtgatacccttgttcgataacgtgacatattgtccgaatgatcttgtgaaagtttcaggtgtactttcttcgtcatgttggctgttcgcctgtaaaacgagccaaaacataaaaataaataaattaatgaagactgtaatgatggtcactatgatgacagataccatgtatctgcctgttaatcgccaattcatccttacgcatcctttacaacaaatttgtagcctaaccctttcacagtgacgagaaagtctggttttgatgggacagtttctattttctcacggagcctgcgtatatgaaccatcaccgtgttgtcagaaccgaaaaagtcttctccccatacagcttgatagagtgtttctttactgatcacccgattgggatgctgcagaaaataggccataagcataagttctttaggtgttagctcaatagccgcttcatttttggtgagctcggcttgttgttggtttaattcaaatggccctttttttatcacggttccggtttgagaaggctgtaagtaagagacccgtctcagctgcgctttgacccggtatgcgacttctttagggctgaaaggttttgtaatgtagtcgtccccgccgatggcaagtcctacaattttatccgtttcctccccctttgcagacaaaaagataataggaatgtgtgaaatgtcccttatttgcttgcagatatcatagccttcaccgtctggcagcatgatatccaatatcacaagatcgggattttcttgatgaaattgagccaatccgtcacgggcagttgaagcggtcactacgcgatcaatgccttctcttattaatacggttttgatcagttccaaaatttctttttcatcgtctatgattaatactttgctgtgaagccgtgacatatattgatcactccttgaagtcattgtcattattatacccaatgtccgtgtatcgttaaaaaatcaacattctctcccacagaaaataagccaattttcttttccgagtaagaaaattggcttaatgcaatgctgatgcctttaacgctttacaacaaatgttgtcacgctttgagccggcagatgggcccaaaaatgattatccgttactttgagatccgttccaggttgaagattgctgctgctgctcgtgatccatctggatacttgcgaagcagacccattctgcaacacgaagttttggttgacccctgtgttatttttattaatggcaacaatcacgactttattgtctcctttataggctgacacgtaaacattcggttcaggatttttcgttgcatcaatccttacatagccagggcgcacaaattttgagaaatgagccatattgtatccgcgtttgctgatcgtcccatcttctttcatcgggccgtatgatctgcggatgtaccaccacacataagcttgaaaatctccctctaccattgaatgatgaatatgctctgaaacacctaaagcctcaggccatcgatccgccgagttgttatcactgttcggatagtatacttccgtcatccaaaggtccttccccgctcctttttgtttgaaaagaggataaggaaactgactgacctgagtgccgtacaggtgggttccgaggatatccatattcctaagcgcctgcggatcgttcaaaatggggtccgatatatttttcaggtattgaaatgattccggcgcaatcacacgggcattaatggaaccggcattctctctcatgaaacgcaggatttcttgaggcgtccaccatgtccattcgtgagcgtaatcaggctcgttctgcatagaaatcgcatacagattcacaccattactcttcatgaaattaacgaaatcgttaagatgctgtgcgtatgcggcgtacttatcgtatctcagccgcttagctgatgtgtcaccattatgattgaaagtctcaaccatatcgtttggcggattccaaggggaagcaaaaacgattgctccgtgtttgatcgcactctttgcagtctccacttccttgtaccaattatttctattctcatctacatgaattcttaagaccgaaaaacctaactgattctgtccattgccaaaagcggtctcccgttgagccgcagtcaagtctccaatccaagccgggtgattcattcctccaaaaccgcgaatcacttgtctttctgcagatatattaactgttgcatcacttgctgctgaaacttcagtaactcccggtcctaacagcatgacggacagcattgtgaaacataccaataatacacaaattggtttttttacgctcgacatcattttttcctctccttcatttatcttttatagacttagaaaacgtacctttgcttatctttgtgtaaactgccagtaatcaacattaaacaagtttcctgtaccagttccggtaaatacaaagaatacgttgtgaacaccggatgcgccgcttaccgcagtttctatttctctccaggattgcgttccgcctgtggaagggacattcaaggttccgacaagcttaccgtttgcactgtctagtcgcacttctatttttccgccgagagcggacgctacatttgctttaaacgtcctggcaccgcctgacccgaaatctgcatttcctacagcaatccagtctccgttatgaatgtttgtgacatgttgattattgaccggcccgccgggtgctgaggatgcctctgtcaaaatccgtccgttccaggcaaacgtttccgcttctacccggttatatggattcaagttggatagctgtttgacacctgcaaaatttgccgctacctcttgcagggagccatctggattatgcacaagcttatttatatggggagaacggtatcctttgccggccccgtaaagagcggagctgacagtttgagtatgatacaccacataccactcgtttttaaaattaaaaacagcatggtgattgtttccgccgcctccgaaaaatgctcccggatttttcagaaagtgccctctatacgaaaaagaattcataggacttgagctggtcatatagccgatctcacctggaggtttatcggccgggtgcgcgcccccgaaattgatacaataggaatagtaatattttccgttatacttatgcattcccgaatcttcaaacataaaaggcgcatcaatcgtagatgcacttccggcaacactggtcatatcaggccctaatttcatgactcttgctgttttaggattggcccattgtccctgcgttggatttgaaccgcccggaacgcctccgccggcatataggtaaccggtaccgtcatcatctacgaatactgccggatcaaaaagccatacaacaccggacattcctggtgtacttggcgtcaccagcggttttccgatcggatctgtccacggaccggtcgggctgtctgcggtgagaaccccgatacctccgccgccgtttgcgaaataaaggaaaaatttatccttaccgttgatctttttcaccgcggctgacggggcccatgatgctcctgcccatttggcaatcccccggccgccattcaccccattggcacccgctgcgggaatcgctccgtgatctgtccagttcaccatatccgctgaagatatgacggatattttattcaaattggcaaatgaattatccttaatcgtgccgtcgctattatattcatagtcatcgcttgacatatagatatagactcttccgttataggtcagcgcaaacggatccgcgcccagatgatggtcgataagcggatttgaattcccaacatgttttgcaattggagtgctggcagcatacgcagacttcccagtgaagcaactcaataataaagcaaggacccataggcatacgcaacattttttacacataacttaacactcctcctttttctttaaattcggggaacttttaccatttgagaccaaattgcagtaccggcagtaaaaagcagactccgcagttaagcaactcaataatagagctagtacccataaacatacgctacacttttttctaataacttgacatccttctttttccttaaaatgtatgatgatttttttaccatttgatgacaaccagtcatggagaacggctctggagtaagccttgcgaacacaggagtatgactctcgcctttttaataaaaaacgccgctgagtgccaggccagcggcgttttacacttgatcacttacattttgtcaaacttcgtgtcgccagcaaacgatcctattgacagttgttcttcaagaacaagtccgtgatgatgccgttcttcaatccgtttaataatagatcgaattgcatccgtattttcttcgatattgtgaggttcaaagatcgtcacgtgatctccttttaatttgtactcaagataatgctgtgctgttgattgtgtccagcccctatcatcggttacatcgccgcatagcaaatgatggatgttggcgttaacggcgccggaattgatcagttcattgtgatacgcaagatagcctctgattttatccttaatcgaaggaatggttaatatttctctgtagtagtccggaataatgtccatattcagatggacgatctcttggatttcctcttccgataaatgagttaccgaatcggtgattttagaatccagcataatcacatcagatacggtgcgcccccgcttttctaaggctttggcaacctcaaaagccaaattcgatccggaagagtaaccaagcagaacaaaaggcccttgttcttgaatgcttatcatgctttctgcataccggtcaacgatctctttcccatgagacggctcttctaagaaatcagcggcatagatggtgctgacgccgtcaagtcttttcgccatttcattataaacgagtccatacccgattaaaggcgggaaacagaacacagggattgaatcttcctgattcagcttgacgaatacgttatccgtctcggattcgaaaacggccgcttgaatggcgcgtgccattgtttcgatggtaggaaaatcgtatacggcttgataatgcatgttgattcccatactggcgttaatttgatgaatgagctgcaatactttaagtgaatggccgccaacgtcaaagaagtgatctttaatcccggggtcaggcagagctaaaatatccttccatatatcggccagctgcttttcaattaacgttcctggcgctgcgtattcggttccggtaagcctatttccctcaggagccggcaacgcttttcgatcgatttttccattagcggttatcggcatattctctacttgtacaaaataagccggaatcatatacgtaggcagattgttcagcaaatgacgcttcagctgcgccgtatttaatgactcgtctcctgacaagtaagcgcacagctgttttgagccctctttttcaatcgcgatgacgaccgcttctttgacagcatcgagttgtagtaaagatgcttcgatctcgccgagttctatccggtagcctcggattttcacttgatgatcaattcttcccaaatactcgatattgccgtcaggcagccatcttgccaagtcgcctgtacggtacatcagcttccctgcttcatatgggtgagctgcaaacttctcagccgtcagctccgggcggttcaaatagccccgtgcgagcccgtctccggcgatacacagctctcctgccacaccgagcggttgaaaatattccgattcggggtgtacgatatacaattgaatgttggaaatcggtttacctatcggaactgagttaagcgtttctcccgcttcgcattcaaaatacgatacatcgatcgtcgcttcggtcggcccgtataaattgatgatttgagcctcacccgccggtgtgatcaagcgatgaaaccccgcaacgtgcgcaggcgtcaaagcctcgccgcttgcaaatacatattttaatgatgccagctttctctttaattcctcgtcggatttttgctccatggactcaagaaaagcatgcagcatcgcaggcacaaaatgcataatggtgacatttttctgcgcaatcgtatctaagatgacgtcagggttcttttctcctccgtttggaagcaataccgctttagaaccagtcatcgaccaccagaacaattcccacaccgatacatcaaaggtgattggggttttttgcagaatgacatcctgcttatccagcgggtaatgtttctgcatccaaacgagacggttgattacggatcggtgttccaccataacccctttcggtcggcctgttgatcccgaagtatagataacataagctaagtgattcggtccggcagtctgtttcaagtttgaaccatcttcccaagagaatcgcggatcttccaggtcaagcacttttcccgtaaaaggcacgcttttcctcaagtgactctgtactaacaacagcttcgtatccgaatcctccaatatatagtgaatccgttcttccggatagctcggatcgatcggcacatacgcgccgccggcttttaagattccgaagagtcctacgatcatttccaaggaacgttcggccataatcccgaccggctgatccggctgcacgccttctgattgcaatgtccgggcaagttgattggctctttcattcagttcccggtatgtcagctggctttccccgtatacgacagccgtttgatcaggcgtacgctgtgcttgttcctcaaacaatttatgaagcgtcttttcctttggataatctgcttccgtatcattaaatgcctctataaggagcgaacgttcatcccccgtaagtatatccaagtcttggacgcgaatcgcctgactgttcaccatctgcttaatgatttgcataaaatgctcttccatccgcttgacacttgcatgatcatagacgttgctattgtatacaaaatgaatgtcgatttctcccgcgggcatgacaatgaaattgaaatcgtaatgggtatgctcttccatatggaaattgataatgtccagtgcgtcacgattcggtttcatatgctccatttgtttctcgaccggataattttcaaataccatgatatgactgatcagctgctgcttttgttcagtttgagcctgaatttcatataacggaaatgtatcatacccttgagaagccaatgcctgctcctggctcattttcaacacttgttccacagtcattccaggctgagcggtaatacggacgggaatggtgttgataaataagccgaccatggactcgatacccggaatttctgccgggcggccggatacaaccgacccgaaaacgacatcctgactgttgttgtacctttgcagcaatagtccccacgcactttgaatgaacgtattcacggtgacgtgatgcttgcttgcagtctgtctgatttcttctgacagctgttttccgagccggcatgcaagcctttgtttttgatatcccttggcttggtttgagacaggttctttcagtaaaacagtttgtccttcataaccgtccaaatatttttgccaataggctgaagcgtgcttatgatcctggtcttccagccattcgatatatcggctgtacggggtgacgacttcccgctccgcttttcttctatcaagaatcgcataataggtttcaaatacttcattcgtaataagaggcagacaccagccatccattaaaatatgatggaagctccatatcaatcggacttggtcatcctctgtacgaaggattgatacgcgcattaatgcatcttggataaggtcgaatcctcttgccttatctttttgtacaaagccggcaatgaactcgtttcgttgtttattcttcatgcttcgaatatcttcaacagttatttcgatcggtttttttcggaatacgatctgcaaaggctgatctttccattccgtataaaaatgagtccggagaatctcatgtctttccgccagctgcgacaaactcattgtaaatgcctcgatatccaagccgcctttgagatcaaaaacggcttgttcaaagtaagctctggaagccgaatcgattaaactatggaacagcatacctttctgcatgggagttaatggatatatattttcaatctcgccgatatgttgtgtttgctgaacaaattgatctaattcctcgattgttatgtccttcagtgagatatcgcttggcgtcaggtgaatgtcttcttgagctgcgcaatgttcgatgacttcttttaggctgttctttaagagagctgcacatgtttccatcgtttctcttcgatattgtttaccgctgtaactgatggccaatgacagccggccgtctgagatcatgccgttaatgtcaagcgtataggcaatgggatgtctgtcgcttgcaattttccctccggagtaaggagatacttcgattcctccattttcgagatcttgatcaaattgtccgaggtaattgaagctgatttccggatgtccggtccattctgatgccttcggatgatcggacgaatatttcatcaggccatatcctattcctttttggggaatctgacgcagctgttctttcaccgtcctaatccgctgggagatgtcccggtctgcctggatttgaagagaaaccgggtattgggttgtgaaccagcccactgtacgtgaaatatcaacgtcttgaaaaatagattccctgccgtgtccttccagatgaacatgaatttcttcatgccccgtccagcgatgaacagccattccgagtccggtcagcaataaatcattaatgtcagtcgtataggccctgttcgatttttttaataaatgctcggtttcttcctctgtccattggacgatgatcgtttcccggtcttcggccagaccggtctcctgctcattatcctttggcaatttgtgttgcgagatatgtttctgctcaagccaatattgattttctgcttcaaattccggactttctgcataacgtttcaatcgttcagcccataacagataggaatccgtcttcttagggagcgtgagcgcttctccgttttggagctgctcataagctgacgttatatcctcaagtaaaatcctccacgatacgccatctacaaccagatgatgaatcgcaatcagcaaatgatcgccatcctgacattgaaacaatcccagtttcatgagcggtccatcggctaaatggatggattgctgaatgtcatttgctatcgtttctatcgtttcggcagggttgttttcttcgagtaaagagaacacgtcgaggctgaataattctccttcactgatcccgcgggttctggcttcgtattcatgatctccctgaacatagaccatgcgcaaagcatcgtgatgctcggcaatcttcttcatgactttctgaagcttcgattcgtccaaaccccctttaaaataaagcatgacagattgattataatgatgcggatcagggtattgccgggcgaaaaaccaatgctgaatcggcgtcaataaggtacggcctttgatctccccttgttctgcgattcgggtaatgggctcaataaaaggagcaagcccggagatcgtcgggtgtttgaacaagtgtttgatgtcaagcttatacccggcttgatataagcttgaggtcacctgaatcgacttaatcgaatctcctcccagctcaaagaaatgatcatcgattccgacctgttctgcgcctaataccgattcccacaccccggccagtattttttccagttctgtccgcggagctgtataaggatttccagtgagatttcccgttggagcaggcagagcctgacgatctatttttccgttggaagtaagcggcatcgctgccagctgtacaaaataagcagggatcatataggacggaagttgccgggacaggcgctcccgaatttcgcctgcggttaaagaatgctgtgcggtataataggcgcacaaggatgtttccccgttggtttcttgtgccgtaacgagagcttcttgaatcggcggtatttggaaaaatgcggattcgacttccccgatttcaatgcggtaaccgcggattttcacctggtggtcgatccggcctaaatattcaatatttccatccgggagccgccttgctaaatctcccgtccggtacattttcacctctggcacaaaggggtgctgcaaaaatctttctgctgttaattccgctctgttcaagtatcctctggcgatgccgtccccgctgatatagatttctcccggaacgccggccggcaccggcttcatgctcttatccagcacgaaaatgttcatgttgtccgcggcggttccgatcggcactgattcccgtctgtcgttttgcggatcaaaggaataaatcatacagccgacgactgtctctgtaggcccgtattcgttaaaaatttcgatttttccgccgaattttccgctgatgctacgggcgagccgcgtgcttaaattgtcaccgccgacaatgaatttccgaatggtgcactcagcagggatattcatctctttcaataactgcaagtgcgccggggtcagcttgataatatccgtccttgaatcctgaataatgcaatcaagcaaggcagcactgttttctcctccgtagacaataatggaatttcctgtaattagcggagtgaaaacagacgttatcgtcagatcaaaagcgatggacgaatataggggaaagttggttttttcccctttgacatagacccggcgggcccaccaaatataattggttaagccctgatgctcaattgccactcctttaggcttgcctgtggagcctgacgtataaatgacataagccaaatccttcgtactgctgatcggttccaggtcagagccgtcttcgtggtaagagctttcctgatcgaggaaaaccattgtgcccgcaagttccaactgtttttgaagatggctctgcgtcaggatgatatcagcttgggagtcttctgctatatactgtatgcgatgcttcggataatccggatcaattggcacataggcccctcccgcttttaaaacggccaatattcccacgaccagttcgatctcatgctcgcaaataatcgcagtgagccggtccgtctttaccccctttttccttaacgttcgggctaattgattggcacgttcattgagctgacgatatgtgaattgcttttctccgtaaataacggctgcttgatccggtgttcgtttcatctgttcttcgaataactgataaaccgtcttatcccgcggatattcagttttcgcagtttgaatgtcaacgagaagtgtatgtgtctccgattctggcaaaatatccacttggccgagggggaggtcaggctgaaataatatgacagaaaatagccggtttaaatgtccgagcacctgcatcatatactgacggtcatagacttgttcattaaaacataattttaggtcaatcaagtcttcacccatagcaaactgaaataaagcatctgcagcagccgtttctatgaaaccatcagaatgaatttgctctagtgaaacaactgtatggatgatcggcaaatgatttgcattgtagttcagcctcagctgtccggccattttatcaaagggaacgtcctgatataagatcgcttcgtccagcgtatgtttcaattcatggaaaattgatttaaacgtactgccggaattgatctgctgtttgattaacatgagctggtctgaacgaagatcttcatcagtttcgtcttcaaaggctggaacccctgtaatcactccctcatcccccgtgtatttgtataaaagggattcaattccgaccaggagaaccagatagacggccattggcgtttggttcgtcatggtcaggatgcgccgtgatacctccgcactcaatgaactgtgaatacagtcagatccgcttgttatatcacgctttactgttgagtcggacacttgaaacgaagggaatgcaccgggacggtcttccgtgtgaaacattcggccccagaacaactcctgttgtttgaattctgacattcatatccctccagttggtttcattcctgttttcaggcagctggcggcagccgcggcattcatgccgggacagccgctgcccccgtgattagaaatccaattcgattgtgcttgcgagatgtttacttttgtttactttttcgcttaattgaatgtcttttaaaggaatggatgggtttctcataatcgccgaaaggatcatgacgtaatccttggccaatacagcaatggttttctttttaaacagttttgtacagtaatcaaaactgccctgaatctcatcttgatctattaagaagttcagctgtaaatcaaacttggctgccgtctctgtttgttcataaggcctgactgcgagagagtccacttcaatatccgtttgttccgtattttgcaggacaaacatcgtatcaaacaatggattgcggcttaagtcccgttttacacccagtttttcaactaattcttcaaaaggatactcttgatgttcaaaagccttcagcatggtttctttcgtttccgttatataatccaaaaatgtcttttccgccatcggagcggtgcggatggctaatgtattgacaaacattccgataatgggttccaaatccgcatgcggtctccccgcaataggtgtgccgacgacgatatcaccctgaccgctgtatttagccagcagtatggaataggccgagaacaaaatcatgtaagctgtcgtcccggtcaattcttccagctgctttatcccttgggtgacagtcttatcgagcgtaaaattgtgccttttcccatcaaagcttctaaccggcggtctcgcaaaatctttcggcagctcaaatgaaggcagctcttcatgaaatacaccaagccaatacccttcctgcttcttgattcgttctctttgctctttttgatgtttccattccgtaaagtctttgtactgaatacggagcggagctaactctttgccgtcatacaattgaatcagttcttcgacaaaaatattcatggaggcgccgtccgtgatgatgtggtgcatgtcaaacatgaaaatatgcaggtcttgttctaactcgatgagtccggccctgagtaatggagcctggctgagatcgaacggccgcacgaaggtgcggaaacattcctcaacctcgtcagctgttgccttgtatctttccatcgaaaactccgcttgcggtttgatcacctgcaccggttctccgcggaccagctcaaaaccggtacgcagtgattcatgacgctggatcagtctttggaaagcggtttgcaagcgatttatgtcgagttttccttctaatgtaaggattcccggcatattgtagctcagttctccgccttctatttgtgttgacaggtaaaccatcttctgcacggaagatacaggatagacatcttttgctttggctttcggaatgtaatccggcccgttggtttcagctcctgcaattgcctttgccatttcctcaactgtcggacattgaaagacctctcttaatgaaatgtttttgctgaattgcttatgaattttggcgatgagcgtcatcccccgcaacgagtggccgcccaaatcgaaaaagttatcttttacacctatttcttttaccttcaaaacgtcttgccagatgcatatcagctgctcttccatattcgtccgcggagcaacgtagtcggttcccgtttgtaaacctgcttcaggcatcggtaatgctcttcgatttacttttccattgccggttagcggcagtttctcaagctggatgaagtatgaagggatcatgtatcccggtatttggccagcaagtttttctttcagctgactgatcgagagtgattgctccgctgtaaaataggcatataaatcgatttggccatcggtattttcttttgataggacaactgcttcctgtacgtgcttgagaagagcggcctccacctcaccgagttcaatccggtaaccgcggattttgacctggtggtctctccttcccgcatattcaatgtttccgtcaggaaggtaacgggccagatcgcctgttttatacatccgctgattcgagtcatatgggtgcggaacaaaagtttcgagtgtcaaaggctccctgttatgatagcctctggcaaggctcgctcctgaaatacaaagttcaccgacgattccgacaggctgaagcgttccggcttcattcaaaatgaaaatctccgtatttgaaatcggtttgccgatcggctgaagctcctgatctgtatcaggatcgacggtatacatggtcacaacatgcgtctccgacgggccataatgattatgcaatgtgacttgatggcgtgccagcatgtcacgcagcatacttgttacgatgagctgttctcccgcagcgatgatgtgatccacgcacgcggcaaacggttcgaaatattgtttctctgaggcaaggagcttaaggaacgctgtcgggaggaatgctgtttgtatcccgtgcgttctgacaaaatcattgagctgacgtatgtcacgttttgcctcattgccgatgataaagagtgttcctccgcttgaaagcgcggagaacatttcttgatagcagacatcaaagctcatcgcggcaaattgcagcactctgtcaaagcgaagctgcgtatgatcctgctcataagcgagcagattcgtcatcgtcttgtgctccagctgaactcctttcggctgccccgttgtgcctgacgtgtaaataacatacattaaatcattttccgagcaggaaagattaagattgtctgctctgccttgatatatcatcggatcatcaagctgaagcacttctccttcaaagcgcggcggaatagcgtggcctgcacaagtcaaaagcacaccggcgccgctgtctttcagcataaaagcccgccgtttttcgggaagctccggatcaataggaagaaatgctgcgccggcctttaatatggctaaaatgccgatgatcatatgtgctgagcgatccgtgagaacggcaacaacctgatcagtgcaggccccttatcttgaaggatgcgcgccagctgattggaacgctcattcagctgacgataagtcagtgtctgaattccaaacatgacggcttcatgatccgggttaagctcagcctgctgctcaaaaagctgatgaatcgttgtcggaattcgtttttccgcaactgcagtatcgttaaagagttgctgaatgtctccttcctcttccttggtcatcatattcagacgagccagctcggcatcaggctgtttaataatcgaatcaatcagctgcacaaaatgccccatcatgcgttcgatcgtttccggtttaaacagagccgtcaagtattccattgtgaactgaatacccgactcttcttccacagccgttaaggttaaatcaaatttagccatcgtatgttcgcttggatatggtttgaaagtgacgtcatttatctctaactgttcctgctccgtgttttgaagcacaaacatggtgtcaaacaatggattacggcttaagtctcttgcgatattcagttgatcgatcagcgcttcgaacggataatcttgatgctcataagcttttaatgcattctccttcacctcggacagatactgagagaacgtcttccctttttcagggtaatttctcatggccaatgtattcacaaacattccgataatcggttccaaatcggcgtgcggtcttcccgctataggactgccgacaattatgtcttcctggccgctgtattttgaaagcaataatgtataagacgcaaggagcaccatatataaagtcgattcagtttgggatgccagctgctttaacccggcgcttttttgcttatcaagcgtaaactgcattgtggctcccgcaaaatcccgtgccgacggccggatataatcggtcggcagatgaaggacaggaacgtcgccgctgtacagctctaaccaataggcttcttgattttggatctgttttaaccgcgcttcgccggtctgccatactgcgtagtccttatactggatgcgcaaaggcggtaatgtttctccttcataaatgcggataaattctttaatcaatacactcatggatgttccgtcagaaataatatggtgcatatcaaacatcagaattccgcggtcaggttgaagttcaatcagccccacgcgaagcagcggcggctcatccagatgaaatggacgaataaatttgcggatataaaggtccgcatcattttcttctgcctgataccactctgcttcgaactttgcgtgatctaagacatactgaacgggttctccgtcagccattttaaaaccggtgcgcaaagattcatggcgcaaaatcagcgtgcggaaggcttgctgcagcttgtcacggtcaagcttgccttcgacagccatcagtcccagcatgttgtaactgagttctccgccttccaagtgattcaggatgtacaaccgtttttgtgctgaggataccggataataaggtcttttttcaattgcaggaatcgcagcatatccggtcagctccgtcttcgtgatcgtctgtgcgagctgttcaatggttgggagacggaagacgtcccgcaaaggaatttggacatgcaattgcttttgtatttttgcaatcagcgccgttgcccgcagggagtgtccgccgatctcaaaaaagtgatctctgatccccacctgctctaacccgaggacatcttcccaaattgctgtcagctggatttcttccgaagtttgcggcgggacgtactctatgccgccgtcacgctttttgaccggagccggcaataactggcgattcaacttcccgtttggcgtcagcggcatcttatccagctgcacaaattgagccgggatcatatatcccggtaaatgccgggccattctttcgcgaagttcactgatctgtattgtcttatccgcagcaaagtatccgcacaagtaatattcatcatctgcatctttaagggcagctgcggcggcttcttgaatatcaggaacgttcagcatcaccgattcgatttcaccgagttcaatccgaaaaccttgaattttcacctgatgatcaatccggccgatatattcaatatttccatccggcagaaggcgggccagatcaccggttctgtacattcggtcctccggtacaaacggatcggcaacaaatttttcgtccgtcagttccggcaggttcaagtaaccccgcccgacgccgtcccctgcaatatacagctcgccttggacgcccgccggctgcagccgtttttttgaatcaagaatgtacatgcggtttctgcctaacggcttgcctatagggacatagttttggctgcgtgcccacgcattggaagaacattcaatgttgaacagagacgcgtctacgcaagtctccgtaggcccatatacattggtaatcccaggtgaagcgccatgatcgccgaataattgcatgagcttatttaccgtcgttttggaaagtgcctctcctccgattaaaagatgctgaagcggaactccctgcaaatcacctgcagctatcaaaagctttaagtgggcaggtgttccgtcggtgatgtcaatcgaatgctgccgataataacggcataaggcagcaccgtctgacacaatctctttcggaacaataaacaaggtatgtcctgacagcaaggaagcatacatttgctgaacagaagcatcgaaataatatggagcgagcatggctacattcagctccgcatcgtaggcagagtaaatttggcgtcgaagtccttcaatcaggtgaatgacctggcgatgttcaattaacgtgcctttaggattgcctgtcgtaccggaagtataaatggcataggccagttgactggactgataagagagtgcaagactgctgtctttttggtgatagaaatgttcctccatgagatcgatacatgttcctgagaagccgatgtcatcctgcagcttcccgcggtaaagcaatacgctgatgcttgaatcatttaaaatataactgatgcgttcagacggagaatcaggatctatcggcaaatatgcgccgcccgcttttaaaactcccaagatgcctacaatcatctcaagcgagcgttcagtcataataccgacaagcttatcgttccgcacaccttttgcctgcaaggttcgcgcaagctgattggcacgccggttcagttctccgtaggtgagttgtttaccctcgaatacaaccgctgtattgtccggagtacgatgcgcctgttcctcaaacagctcatgtatcgtttgttcaagcgggtaatgcatgtcattagactgaaagcggctgagcaaatgttctttttcttgcctagagagaagctccaattcttctattttgacagacggctgctgtaatacttgctgcatgagctgttcaaaatgtccgcagatccgctccacttctgatttttcatattcgttttcattaaaaccgaaatgaacggccagctgtttgccaggtatgacaactacattcaaatcatagtgggagtgttccagcatatgaaaattcgtaatgttcagctccgtactatgatgtcccgtctcttcgacctgctgaccgatcggatagttttcaaaaatcatgatatggtcaatcaggttctgcttttgttccgtttgggcctgaatttcgtataaaggataggtatcgtatgattgggaagccagagcgttttgttgaaccatttgcaccgtatcagcaaaagtgctgtcctcatcgcagcggatgcgaaccggaatggtattgatgaacaggccgatcatctgttccacatcaggaatttccgccggtcttcccgacacgacactgccgaagacaacgtctgcggacccgctgtatttctgtaataaaactccccataacgtttggatcaacgtatttaatgtaacctgatgctgatttgcgatctgctgtaattgttttgtctgttcgtgatcaaatcggcaggtcacattggcataggcgtattctttttgttcatgctgctctattttatgaagaagcgtggtttcacctttatatccttcgagatacccgctccagtaccgctttgccgctccctgatcttggcggtcaagccactcgatatagttgctgtaaggagctgccgatgacggttctggttccctgccttcttgtaaggcgcgataatgatcaaacacttccttcgtgataagagacaggcaccagccatccatcacaatatgatggaagctccaaatcaaatgatatttgcggtcttccatacggaaaatcgctatgcgcatcagcggatcccgagccaagtcaaatccttttgccttatcttctctttgataggctgcgattgcatcctctctcaggtgctcctctatatcacgcaaatctgcaaaatgaatttgcggtgtttgcgttttatagacaatttgtaaaggagtatcgttccagccgctgtaaaaacgggttctgagcacggcgtatgtttcaaataatcgttcaaggcttgctttaaaccaatcaatctttaattctccctgcaaatcgaacgatgcttgttcaaaataagaacttgaggcctcgtccagcaggctgtggaagagcattcctttctgcatcggagtgagcggatacacgttttcaacctcacctgcatgcggcagttgaatgaggagctgatccaattcgtcaatggacatgccttttaacaaaatatcgcttggcgtcagttccgattgttctctatggacgcaatgcgtaatgattgtccgcaggcggctttgaatcgtttccgataaccgcatgatcgtttcttttgcgtactgtttgctgctgtagctgatcgtaagcttcagccggccgtcggtgatcattccgtttatattcaatacatacggtctttcttgatttccgctagagtctgaaccgcaagaataagaagataattgaaccccatgctgctgtaaatcttggtcaaactgtcccaggtagttaaagctgatctcaggattgagtttcgatggcattccgccgcttaagtaccttgctattccatatccgatccctttatgcggaatttggcgcaatccttctttggtcgtcttgatataatcagagatctctttgcccggctgcgcgtgcagcacaaccggatacagacttgtaaaccatccgaccgtgcgggagatatctatatcttgtataatctgttctcggccgtgtccctctaaatgaatcggaatttgtttcagtcctgaccaatgcgatatggaaagaccgagagaagttaaaagcaaatcgtttatctccgtgttataagcgcgattcgcttgttttaatagcagctccgtttcctctttcgtccattccacagttgctgtttcactgtcttttgcagttgtatgggtttcatgaaaatctttaggcagcggtttgacttcggtttgttcgatctttgtccaatattcctgttcctgttttatggtttcacttttcgcatattctgaaagtctcttagcccataattggaaagagtctgttttttgcggcagttgaatcactcgcccattctcggcttgcttgtagccgctaacgatatcttccagtaaaatgcgccatgaaatcccgtctataatcaaatgatggatggcgatgagcagatgatctccatttgcgcattgaaacaacccggctttcattaacggcccatcacttaaacgcatactgctttgtatctcatcagctttggcttcaattgtccgtcccggatcggaatcttctttcagattcaggacttctaagcggtacagtccgctttgggcgatttcttcattctgtgcctcgcagccattttccgtagtccggaacgtcatgcggagcgcatcgtgatgttcagcaagtttttgcagggtttgacgaagctgcgtttcctgaaaaccttccggcgcatgcagcatgacggcttgattataataatgctgatctgtcgttatttgttcgaaaaaccaatgctgaataggagtcaggctgacttttcctttgacctcaccttgatcggctatacgcagattctgcttgatatgcggactcaattctgcaattgttgcatattgaaacaagtctttgatttccattttgtatccttgctgatttaatctggaggatacttgaatggatttaatggaatctccgccaaggtcaaagaaattatcaagaatactgacgttttcagcgcctaataccgattcccaggcagaaactaatatttcttccgcttttgttcggggagctttatactctgctctgtcctgcagctcgaaatccggagccggcagcccttttttgtttatttttccgttagaagttaaaggcatttcatcaagctcgataaaataagccggaaccatataacttgcaagggtatgagacaattgtttccggagccgggcagccgttgtttgcccgccgcttacgtaatatgcacacaattgtttaaacccgtggacatcctctctggctgtaacgacagcttccttgatcgcttcttcttgaagcagtgccgcctcgatctcgcctaattcgatacgataacctctgattttcacttgttcatctattctgcccgcatattcaatgtttccgtccgccagccacttcgccaaatctccggtcttatacatcttcgctccgggttcaaacgggtcatcgacaaatttctctgccgttaattcgggacggttcaaatatcctcttgccacaccggcgccgctgatatagatttctcccggcactccgatcggcgcgggtttcatattctcatcaagaacgtaaatgctcgtgtttgccgcagcggttccgatcggtaccgattcccgtctgtcctttacggcatcataacggtaaatcatgcagccgacaacggtttccgtcggtccgtactcattgcatatttcaacccggccttcgaactgttcatgaatgctgcgggctaaccgggtgcttaagttttccccgcccacaatcattcttcggacagccgtttgatcggcaatgttcatttctttcaaaacctgcaaatgggccggagtcaatttaatgatatccaccctcgggtctcgcacaatcgattcaagcagagctgttttatcttctccgtcatagacgatgattgcatttcctgtgacaagcggcgtgaaaatagaagtcaccgtcagatcaaaagaaattgacgaatacaatgggaagttggctttctcgccttttacataaacctctttcgcccaccaaatataattggtcaagccttggtgctcgattagtacgcctttcggccggcctgtggaacctgacgtataaatgacatatgccaaatggctcacatcatttatctgagcaaggtcagagccatcttggtgataagaactttcatcatcaagtaaaaccgtgacgccttcataggcaagctgtttcctgacgtcccgctgcattaaaacgattccggcttgggagtcatccagcatataccgtatgcggtcttgcggatattccggatctatagggacataggctccccctgattttaaaacggcaaggattccgaccaccgattcgatgctgtttctcgtgatgatggctacaggctgatccgtctggactcctttcgctcttaacgttcgcgcgagtcggttggcccgcttattgagctctccgtacgtgagctgcctgtccttatcaatgacggctgcttgatcgggcgtacgctgcgattgctcttcaaataattgatgaaccggcgtctgcggaaacggcgcggccgtgtcgttaagcgtctgcagaagggttcttctttcgccttccgttaacaattccgcttgatccacccggatatccgcatttgtcacgacttgttgcaggatttgcatgaaatgttcccgaacccgctctatgcttgcccgatcatacacatttgcattgtattcaaaagagatggtcatctcgtcgcccggtataacggtcaaattaaaatcgtagttggtctgttcttccatttgcacgttggagatcgtgatggatgttccgttctggcggcctatactttccatatactgatcaaccggataattttcgaatatcattaaatgtgtaattaaatcttgtttttgcgttgtgcgcgcttgaatatcgtacagcgggtgcgtctcaaattgttgagacgctacagccctttcttgcgcctctttcataagctcggcaaacgttgttccggcttcacaccggaaccggacgggaatggtgttaatgaataagccgatcatggtttccacgtttggaattccagcaggtcttccggatacaacacttccaaacacaacgtcccggctgcggttatatttctgcagcaaaaccgcccatgccgtctgcagcagcgtgttcagcgtgacatgatgctggcctgccgtccgcttcattttcgaagtgagatcggagcttatgtcacacgtcactttttcaggaacgtatcgtccgtcttccgctgcatggtgatccttaggaaggccggtttgctcctcatatccctccaagtattgatcccaataagccgtggcctttttcgcatcttgccggccgagccattcaatatattgactgtacggagtaattgatgattgttcaggctgcttttgctgaagcaaggcaaagtaattctcgaatatttcttttgtaatcagcggcaggcaccagccgtccatcaaaatatggtggaagctccagataaaacggtatgtcttttcatccgtacgaaggatgaatagccgcattaacgcgcctttttctaagtcgaacccccgcatcttatcttctctggcatactgctgaatcatcgcttctttttgtgattccttcatctctcgtatgtcattgaattgaaaaccgatttttttcgttttgaatataatttggagcggctgatccttccagcctctgtaaaaattcgtgcggaaaatatcatatttttgcgataagccgtccaagctttttgaaaatgaatcaatctccagatctccatgcagatcaaacatcgtttgctgaaaataagcacctgaattcggatcaaataagctgtgaaacagcatgcccttctgcatcggcgttaatggataaatattttccgcttcgcctaattcacgcgtctgctccaaaagctgttccagttcgtcgattgagatatcttttaacaggatgtcacttggtgtgagagaagtctgctgccggcttacgcaatgcgcaatgacttcttgcagactttctttcaacccttgggcaaattgcgccatagtagatctttcgtattgtttgctgctgtagctcagtgtcagtgataatgtcccttcggcaatcatgccgttcaaatcaagcacggccgttctctcttggttttcgttcatcgataaccctgtggaatatggcgatatgcgcaaagcctgatgcttcaggtcttggtcaaattgtcccaaatagttaaacgatatctccggattcagctgcatgctgtcggcttccggatgcccggatatatatttgatgatgctgtaattcattcctttatcagggatgcggcgcagcccttcttttacgatcttgatccgctgcgacaggtcttttccggcttccatcctcaggacgacagggtactggcttgtgaaccatcctatcgtgcgggaaatgtcagcatccggaataatcggttctctcccgtggccttccaaattcacgacaatgtcttccgtgcctgtccacttgtgaacagccagccctaacgaagtcagcagcagatcgttgatatccgtgttgtaggcgcggttcgcttgttttaataattgctccgtttcctcttttgtccattgaatcgtcacttcttcgctgtcacttaataacgatccttcgctgatagtgtccttaggcaatggctgaggctttatgcttgaaagctcagtccaataagcaatctcctctttcatgtcggtttccgccgcatatttggacaattgatcggcccagaatggaaacgaatctgttttttgcgggagctggatcgtttgtccgcgttctgcctgctcataaccgcttgcaaaatcttcgagcaaaatacgccaggatactccgtcaatcagcaaatgatgaattgcaatcagcaaatgatctccgtccggacattggaacaaaccgagcttcatcaatggccctttgtctaataccatgctgctttgaatctcattcgctttatcggcaatcgcttgagccggatcggtttcccctttataattcatcacttccagatggtatagttcactttcatctgttcctgtaattcgcggagcgtatccatccggcgttttttcaaaaatcatcctcaaggcatcgtgatgcgacgcgatctgttccatcgtccggcgaagcggagcctctttaaagctttccgccgaatataacatgacggcctgattgtaatggtgtgcatgcggcatgttttgttcaaaaaaccaatgctgaatcggggtcagcttggttccgccattcacttctccttgatcagccaccctgctgaccggcgctacaaactgactaagttcagcaatcgaggggtgtttaaacaaatgcttcatatcaaccttgtatccggcttgatacaatctggatgacacctgaattgacttaatcgaatctccgccaaaatcaaagaaattatccagaattcctatacgttctgcccctaatacttcttgccagatagacgccagcagttcttctattgtgttccgcggggctatgtattcgtattccgcccgcgtattttcgtcagcagcaggcaaagctttcagatcaatcttcccattggaagtgagcggaatgcgttccaatgggataaagcgggagggaatcatataattcggcagttcccgggataattcttttctgaactgcgcagcggtcaaagaaggcccgccgacataataggcatacaattgtttggccccgtctgcgtcttcccgcgcgacgactgcggcttcacgaacgttttccagattgaacatggctgcctctacctcgccgatctcaatccggtagccgcgaattttcacttgatgatcaatccgccctaaatattcgattcttccatccggcagccatctggcgagatcacccgttttatacatcttttgaccagggacatgcagatgctccacaaatttttcctccgtcaattcaggacgattgaggtagccgcgggccactcccgctcctccgacatacagctctcccggtacgccgatcggctggatttgatggtgcgctcctaaaatataagcttgatggttggccaccgggctgccgattgtgatctgttcatcagcggactgaacagggtgaaatgtagataccacgctgttttctgtcggtccgtattcattattgatccgaatgcgaggctgcagagaatgcagcttctcaactgtatctgtttccagctgctcaccgcctacaacaacatgctgaacatggatgaagtcctctgtgttcatctgttcgatcatcgttttcagaagacggggagaagttgagaaatgagtaattctctcttgttttatggcattttgaatggcgaaagtttctttattctcttcattaggcaataggtgcaaagttgcccccgagatgagcgggccgaagaaatttaaaatgaacgcatcaaaaacatacgggtacaagacaagcacgcgatccgccggagaatgcttaaaaaacgccttcttccattggagcgaattcacaatgccgccgtgttcaaccatgactcctttcggctttcctgttgtacccgacgtataaatgacataggctaaatggctgtgtcccgttgctggtgataacaatgagctatcggcatggtatgatgtttcatcattcaaatcaatcaccgggccgtcaaaggtgagactgttttttaaatgacgctgaacaaggagaacgtctgcatccgcatcatgaagcaaatattgaagccgctcttttggatattcaggatccaggggcacataagcgccccctgccttccaaacggctataatggatacgatcatctctaatgaacgatcagcgagaatggcgactaacgtatcgggttgaaccccgcaattacgcaatgttcttgccaaacggttcgccttctcattcagttccctgtacgtcaaatggtcgtttttaaacttgacggccgcatgctcaggcgttctttctgcttgctcttcaaataattgatagactgttctgctcccggagaaatctctgacggtgtcgttaaaatcaaacaatagcttctgtttttccgcttccggtaagatctctgccgtatggatcgcggcttgaggctgaaacagaatcacagacagcagctgatccaaatgggacacaatttgattgatatagcgctcatcgtacagattgccgttataaaaaagcttcaaatgaatcccgttgttctccaaatcaaagtgaaacagcgtatcggctgcagtatcttctttaaattgcaaggaatgaatttcgttaagcgaaacgacggtatgaatcaacggcagatgctcgtcattgtattgcacgctcagatgctgaaccatttttctaaacggcaggttttgatttttcagagaatcattaacggcttctttcagctgcccgaatacggttttaaatgtactctcgtttgaaagcgtattttttaagaggacaatgttgttaacggctgactggccggctttttgcttcgataccgtcggaatgccaagaatcaggctcgtttgatccgtatatttatataacaagcattcaatacccgccaataaaatcagataggccgccatatcggaatgattcgccattgtcatgattctttgagatacttccggagataaggaacggcagatgcatttttcctggtagccggtacgggcaaacgacgctttatccgctgctttaaagtaagggaatgcgcttaatccgtcttcttcatcaaacaggttttcccagtacgtttcttggtttttaaataccgacattggagcacctcattttatataatttaaagaaataatgcttttccctaaaagttcaattgaatagaatcaagcgcgttctcttcttcctcattgctgccgctcaatccgatatgttcaattagaatgcttggctgttccaaaatcgccgatagaatgtgtaagtagtcgtttgataaaacctcgattctgcttttcttaaacagttttttcgaatattcaaacagtccgtgatagttgtcttggtccgcctgaatcgacaaggtcaaatcgaatttggcaaccggatgatgaaatgaatacggcttgagttgaagagaatcgaaagtcaattcagcatgatcgagattttgcagcacaaacatcgtatcgaataaaggattgcggcttgaatcttttggaagatgcagatgctgaattaattcttccaatggatagtcttgatttttataggcgttcagcatgttttcttttacttcgtttaagtaggcatcaaatgttttacggcccgccgggtgattgcgaatgactaacgtattgacgaacattcccacgaccggctctacatccaaatgagtccgcccggcagatggcgttcctacgataatatcttcttgtccgctgtacttggataaaagaatcgtataggccgccaataaaatcatatacagtgttgctcctgtgtcttcttccatttggcttaaacgctgtttcaagtgttcgggtataagaaattcaaatgattcgccttcgtaatcgcgtatggcaggtctctcataatccgcaggcatatccagtacaggaatatcactgtgaaactgatccagccaatacgcttcctggctcttgatgttccgtttctgaatgtccgattgctgccaaactgcaaagtctttatattgaatagagagcgggtccggttcgttcccctcgtagattcggcttaaatctttcatcagaatattgacggacacgccgtcagaaatgatatgatgcatatcaaccacaagcacgtgccgtgcaggttcaatttcaatcagtccggcccgcatcagcggcggtttggctaagtcaaacgctttgatgaaatcaagcacacggtcttccgctacttcttcgcttgcttgaatccgttctatcgtaaagtcgacgttctgatgaatacgctgtgccggctcgccttcatataaatcaaagctggtccgcaacgcttcatgacgcgcgattaattttcggaaagcggcgtttaaccgttcgggatcgatcgtcccttccacattcatggcacccgtcatattgtaagtcagctcgccgccttctgtgtgacttaacaaatacatacgcctctgagctgaagaaaccggataatatggcatttcctttgcagccggaatcggtacatatcggtttttgtccatgtgtaacgccttgtcagccaattgttcaatggtaggaaacttgaatatgtcttttagagacagattcacatccagctctttgtgaattctggcggctaaggcagccgctcggatggagttgcctccgagatcaaagaaattatgtttgatccccgcatggcttattccgagcacttccttccataaatctgtcagtttggactccgtctcattacccggcggaacatattcagctgtcagctgcagactcgcttctggtgctggcagtgccttacggtttattttcccgttggacgttaacggcatatgctccagttggacaaaataggacggaatcatgtagtccggaagctccgatgacaattgttccctaagctgcgcagccgctataggcttgtcgcttacgtaatacgcgcataattgttttaagccgtcttcttcttctttcactgtaaccgcggctttttgcaccgcttccgcgttatgcattgctgcttcaatttcaccaagctcgattcggtgtcccctgattttgacttgttcatcaatgcgcccgatatatacaagatttccgtccttcaaccgcttagccaaatcccctgatttgtacatcttcgctcccgggacatacgggttttcaacaaatttctctgccgttaaatccggacggttccaataccctctggcaacacccggtccgctgatatatatttcgccgattaccccgatcggaaccagatttctgcttgcatcggccacataaatatccgtattggcagccggagtgccgatcggtacaaattcccgcttgtcccgttctgcgtcgaagtgataaatcatacatccgacgacagcttccgtcggtccgtattcattaaaaatgtccagccggcctttaaactgctcgctgacacttttggccagacgggtgcttaaattttctccgccgacaatcattttccgtattgcggtgccgccaccgatattcatcttcttgatgacgtgcagatgtgccggggtcaatttgatcatgtctattcttgagtcccgcataatctcagaaagcacagcgcttttgtcttcgccgtcaaagacaatgatggtatttcccgtaaccagcggtgtaaatatcgaggtcacagtcagatcgaaagagatggaagagtataatgggaagttggttttctcacctcttacataaacctctttcgcccaccaaatataatcagccagtccctgatgctcaatgaggacaccttttggatttcccgtggaacctgacgtatagatcatgtaggccaaatcatgcgcatcgctgtccgattcaagattcgagtgatcctcatggtatgagttttcctcatccaaaagcacaacgtcaccatcatacggtaattgatccagcaggctgcgctgtgtcaacacaacctccgcccttgaatctctcagcatatattggatccgatcttccggatattcaggatcaatgggcacgtatgcgccgccggctttcagaacagccaaaattccgacaatcagttcgatccgatgcgggcagatgatggcaacgaattgatccgcttgtacgccttttgtccgtaacgtccgcgccaatcggttcgcccgttcattgagctgtctgtacgtataccgctcattgccaaaaataacggcttcctgatcgggactctgttccgcctgcatttcaaaccatcgggttactgtttcgttatgcggatacggcgtctttgtgccgttacactccgtcagcagttgatgccgttcggtttcagacagcataggaacggaagacaatgtcatctccggctgctcaacaagactgtttaagatgccggtatagtgtctggtgatctgttcaatggtgtcttttgtgaatcgtcccggtttataatcaaaatgcatctctatctgttgaccggcatcttcgatcgtgagcatcaaatcatacaaagagacccctggatttcgttctttcactttaaatgtacattcattgtgccggatttcatgaaattcaatgttttgaaacacaaacatcgtgttaaacagagactttccggttgtttcccgctgcacatttaatttctccacaagccggtcaaatggatagtcttggttttcgaaagcgtcaagcgtctgccgctttacttcttccagataatccgtgaacgttctattggcgtgcggcttcgtccggattccgatggtttgtatgaaaataccgatgatcttttcgatatccggatgatttcttcctgaagcaggcgtgcctacgacaatgtcttcttgtccggtatatttatgaagcagcacattataggcggccaggagcactgtatagagagtggtttccgccttttgcgccaaatcttgaagcgaacggatgacatccggctgtaaggagcatgtcactcgctgtccctcagaagaccgttctgccgcttttgaaccgtctgtcggcaggttaaggatgggaatttcgtcttgaaattgttccagccaatatgtctcctgccgcttcatggcatcctcattcagccgttggttttgccattctgcgaaatctttatattcaaattcaatgtccggtaatggtttctgatgatataaagccagcaattcatttgtaaggatgttgacggaataaccatccgaaatgatatgatgcatatcgatgagcagttcggcctgctcgttttcaatcttgatcagctccgcacgaactaacggagcttggtccaggcggaacggttttacaaaccggtctgaataggcatcaaattcgtcccggctcattgtccggacatgaacgttaaaatcaacttcgttttcaagtttctgaacgatatcgccatctataatgtcgaaatacgtgcgaaacgcttcgtgccgctgcatcacttgttgaagagatgagatcagggcttgctcatcgtacttccctgttattgatatttggccgaacatattttgcgccagctgatccggttccagttggtgcaggaaatatactctttgctgcgccggcgatgtcgggtaatacgcttttttctcggcagccttcatcgggaggtgcacgacttttgtttcgttctgaatgaaatgtgctaattccttaacagtctggtgattgaaaaattgtccgatggaaaccttttgatgaaatgtcttctgaactttggaaagcataagcgtcgcctggagcgagtttcctcccagagccaggaagcgatctgatctgccgacccgttcaaggccgaaaagttcctcccaaatccgcgccagctgccgctccgtttcatttatcggcgcctcgtaggcttcagtgaaatttgctgtattgcttcctattgaagagacccgcttctggtgttcggcataaagtgcttgtaaatcatgctgttcttcatcggaaaacagcatcatggcgtcaagagggattgaatctccctcaaccattttttgcagcaattttgtaaaacccgctccccactttttcatgatttccggactgatgacgttcgtattaaagtcgaaatcaagaatatattcttgatgcgcgtctgttatgttaagaaataaatcgtacagggtgcattttaccgggtatgcaacgggctccgcttccgcctttccgaaatgcagctttcgaaaaggcctgtctaaattaaagataatacgcatatccggcacttgatcgtgcggaagctctctggccaccagtgttatcgggacggcttggtgccgcattgcaagattcacgctttctttcatactgccaagataaccggttaaagtgctttctgaagtagacgtgttcttcaccggaatcatattgacgcaatttccaatcagatcatgctgttttatatgcgattgacctgctgcggggatcccgatcacaaggcctgactgtttggtaagccggtgcagaaaaagatgaaatgcacccagcattgtcacaaatacgctatttttcatctgaatgcttaatgaccttaaagcctcgctcaatggccgtccaagcctgacggtacaccggtctccctcatacccgttcggataacggacagaacctgtgctcggcagaattggctgctgaatcggttcagagaaatgacgccgccaataacggaccccttcttcataatggccgctgtcaatctgtgcctgctgccagtctaagtattggcgaaacgaaacatctgcctctttcggtgaaatcggttttccttgtacgattgccgcgtagttgctctccagttcttgaacaaatacggcgattgaccatccatcgacaatgatatgatggaacgtgagcacaatcagatgttcattgtgagccgatgtaagcacatggattctaaacaaaggcttttgttcatggaaatggaacggccgcttggcatcttctgtcagccatttttgaatttccgactgccgatgttcatgcgggtgaacagtaaaatcaatgactggtatttctatattcatccgtttctgcacttgctgtacctcgtcatcgggatgaatcactgtacgtaaagcttcatgacggccaacgatatgccggacggcttgttttaatggtgtatgctgcagttcgccctccactttcagcataatggactggtttaaagcggcggacgcttcattcccgtaatgggatgccataaccaattgtttttgttcatctgaaagctcgtacgcccctgatttgttatgtccgccgtcatcaggggaatccgggccttccggaataaatccgcctcggcgaagatccttcaccgtgtctttaacagcttgaatgatgtgttcaatatcatccgcggtatgcgccgtggataggaagcagttgcgtccttcccacacatagatccctttataattgagatggtaaaagaacaagtcgttatcaagcgatgagacaaaccggaataaagaaccgaattgaaccatgcggataggcacttgcgattgttcaaagaagcgattcagccgatcaaccagggaggctgttttttgattcagctgttcatacaggtgttctccctcggtttgtaaatggcgaagcacggctaacgacattctcatggtaagcgggtgagtattgaaggtgccggccacaaacgtgcgtttcgcctcatcttgcggataggaatcgtccccatactgccaggtacccccgtcgatcgcattcatgaactcagcttttccggcaactacccctaacggctgtccgccgccgatgatttttccgtaggtcactaaatcagcctgaatgccgaaccattcctgtgcgccgccgagaccgatccgaaatccggtaataatttcatccataatcagagctgttccggattgctgcgtgatcgcccgcaattctttcaaaaatgcccgcggctgcaaatccggtctgcggctttgtaccggttccaccagtacggctgccaattcatcaccaagactgcggatcacgtccagcgaatcgggattgttataatgtaaaataatcaaatcatccataaagctttgcagtatacccggagccagcggattcgcagacgcggctccgccttttgtgccggcaacccctaatacgccgtcaaacgtgccgtgataagatcccgagaacgccacgactttctttcttcctgttgctgcccgcgccaaacgcagggcaaccatgacggcctctgttccggaattatagaaagcgaccctttccactccggtacatgtgcggatccggtcggcaacttcaccggcgacatctgacatcgggccgagcggaggcaatgatgaacgggctgaatcatcgataacctgtgtaataaaggaaggatgatgcccgaaaaggttaaccccgaatcccatggtgacatcgatatattcatttccgtcaatatcccacattttagaaccgtcagaacgttcggcgataatcgggtatacgatttccttccaatacgaacggaagctggacaagttgcggttgtttgcatgagcaaatcgggtgttgtccgtatattgtttggaacctttcgttttatctgcgtatttcttgatgaaatcttctaagtattgtttttgccgtgcggtatagtgtccctgttcatgcaggttctgaggctggaaaggaacatagggtttcgcttcttgagccgctttcttttctgcagtgacggccggaggcccctgcttgacagaaggaattgatttctcttgcgctttagcgtattctttctcatcggaatgatgtccgctgtttctcaacaaattaaagctatttaattgagcttgcaaggtatcctgaattaattgattctgagaagcgattattttttcaagcatatgctcttgttgaccttctctgcgatccgattcagactgtgcttctgaaatgacctgtatttcctgcgccggaacattctcttgaggcggagcggatgcaaaggacgatggaacggtctcagccaagtaatctatgacactttgaaggttgttcatcgtatcaaaaaaacgatccattgggatgtctgccccaaattcgtccgcgatggcttttttgacctgtgacagcatgatagaatccattccgagcccgataaaatgagcattcagatcgagttcctccgctctgatccccgaagcattgctgattacagttttcaggaaggattcaatgtgcgacttcgattgattgatattcaatgccgcttctcctctcttttcgtcctcgtttaagcgcaattggtcagcttcagcccagcatcggctccgttcaaacggatacacgggcaatggcgtcttttgtacagtttcacctgaataaagcgcgcgccaatcgataacggctccttgcacaaataattcggcggcgcgatgcagccatgtgatccgttcatcttgcgtacgtaaacgctgcttaatcagtgcggctgcttgtttattcagctcttctttatgagcgggcagcatttccttcatattcttgtagccgatgtatacaccgggaaggtttctgtctccctgaatcaggcgggtcagcttatccgatagttcttgtttaccggatacaatcatggcaatgccatgatccaaatgagtcctgcccgtactggctgtatagcaaatggactttaatgaagcttggctgtcatccgatacatattgccggtactgctgtgcgagttcatagagtgatttttcagtatgagcggataaaacaaataggtgcggcccatgttcatcctcgggcgcatactcactttgagaaatatattcttccaataccacatgagcgttcgttccgctaaagccaaatgagctgactccgcctcgcagcggctcatcaccggatgggaacgctgcagcttcctggtttacgtaaaatggtgaagagtgaaaatgaatgagcggattaggttcattaaagtgcactaacggcggatttttcttgtgattcagcatgaggacagatttgatcagcccgacgatgcctgccgcttcaaacaaatgaccgatgttcgatttaacagaaccaatcgcacaaaattgtttttttgccgtatacttttcaaacgctttacaaagcccgttaaattcaaccggatcgccgagcttcgttccggtgccatgcgcttcgatgaaagacagtgtttcaggggcaatgcccgcgtctttccaggccgtctcaatgacctcagtctgagctgccggattcggtgctgtaatcccggcggttgttccgtcttgattcaacgcgcttcccttgattacgccgtaaatatggtctccgtcgcgaacagcatcctgcagaggtttcagcaggactgcggccgcgccttcacctgtgccagtaccgtctgaatctttgctgaacgttttcgtgtacccgtccgaagattccatatcaagtccgatacagatcggcaagagcgatgtccggataccgccggcaagagccatttcacaatcgccggatattaaagatttacatgccatatgaacggcggcaagcgatgaggagcacgccgtatcgactgtcaccgccggcccttttaaatttaagaaataagcgattcggctggctaacacggaagggagattgcccacgatatattgatgaagctcctccggataattcgcagaaaggagacgttcataatcgtagcccaccttcgagtaccctgcatataccccgacacggctcccgttcatgctgccgccggcatagcccgcatcttcaatcgcatgccatgcagactgcaaaaacagtctttggttagggtccataaactgagccgttttaggagctaaaccgaagaacgagtaatcaaagcggtcgatttcatctaaatagccgcccttcacaaactgattctcattgatttcgctttggatggactttaaataatccgccgcatctttcagccgggatgcagggtattctcgaatgctgtgctcacctttttcaagcagattccaaaaatcatttttagttgatgctccagggacattgagcgacatcccgataatggcgatatctttcggcgtcacgtggcttggtttcgctgccacgtcctgcttgatttcagcccggctttcagacagatatgccgctaaatcagtgatagaaggatacgtaaagagatctgaaacggcaagctcgcgtccgaatttctgttctatgcgctcggcaatctgcgataactgtaatgaatttgctcccatatcaaaataactgtcagcgaggtgaacctttttcccattgagcacatcggaaaagatagacagtaattccgtttcaatttcatgaatgggagtctgtccggacgtttccgggctgctctccaaatattcattgatggcggcagactctgttgaaaaattccctgcctcatactgtctggcaagttcgtagcgtttaacctttccgctggttgttttagggagttttcggatcggaaggacatcttttatgctccagccgccccgcttgagcaaatgcttttttatctctttgacaagcggtgcgaatttttcaggtgattttttgtaaacaacaaagagcacgatttctccgctttgtgtcttttgatcatatacaccgcaggcggcaacccttcctaagtcaacctcttccatttcaatcgcgacccgttcaatatcgtgcgggtagatattttttccgttcacgaaaataatgtccttttctcttcccgttacgactaagttaccactttcactaatgaatccgaggtctcccgtttttacccagccgtcagaagtcagcgctttttccgtactctcggggttgttataatacccttgagtcacattgtctcctttgatctggatatggccgatgattccgtcttctactctttcatttgcttcatcggagatccgaagctgacaatagtcaataggtcgtcccacttcgacgaatgaagcgcaattttgatcctctttgctgacgtttacagctctttcaccaagatttaaatagtcacgatgcaaataaacgggaacgaattctttacctaatttagagaatgctgcgccgaccgaagcttccgctaaaccgtaaacattcaaaatggcggatcttttcagattgaatgctgcgcatcttttcaaaaattcgtcacagagctccggcaatatcggttctgcaccgtttgcgatgaccttgatgtgggataaatcccagtctggttcgtttttcagaaatttaaggaagtagttgtacccgaaattaggagaggatagaatactggctttatgttcatgagcttttttcatccaaagaataggtctgcgaataaataattctgtaggcattagattttgattgattccggttatgaagggaacaaggtggcaggcgatgagccccatatcatgcgttaaaggcatccatgataagaaagagtctttcgaatgaacggctagggcattcccaatggcgcacgtgttatgtattaagttgtgatgcgttaacatgactccttttggatctcctgtcgatcctgaagaaaattggataaaggcgagttcatccgcatcaggttcataaaacgaagcggggtaatcgtaggtttgatcttgaatgatgtcagatttttcgtttaattgatgatggaaatcctgtaaatcgtgttctgcagcgtatttctttattttgtccaatactttttcagaggcaatcagaaacggatgatttaatatattccaaatgcgccagaccttcagcttatggtcatcatcttctccgatactgaccggcaccgggatcattcctcctaatatacaagcccaaaaagcaacgacaaatgatttgttttcttggatttgaaatacaatttcctgcttcggcttaatgccgagatgctgtaaatagccaagatacccttgcgcctcttcaaacaattggcgataagagacaaccgtctcgtttttatcggattcgataaaacggatcccgcgatcagagatattgcttctttcccgaatgacttctactaaggtttggaattgactggtatacataggtcccctcctgggcgctttattttaaaatccgcaattcttcccaagccggaagctgtttagcttcacaaattaatttgcataaatggatcgaatggttgagctcttgttctgagagctcattttcatgtctttccattctctctttcagctcttggatttgcgtaaataatgccgtcgtcatattggaataagccgctgaatccttgttgtaatttcgcgcaatgacggattgaatcatcaatttattcagttgttttttgcgtaaacggacaatatgtttctttctttccgctgaattggaaagcaagtgaacatcagatgtctgtcctaagggataaggtacaatgtgattcgttgtttttctcagcagaccggctaaaacattgttcggacccatttcgatgacttctgtgactccgtgtaaaagcaagtaatgcatcgattccgtccatcttaccggcatcgtcatgtgctgcttgagatgttcgctgatcgaatttccgctgctgtaagggcgtgcggtgacatttgaaatgatcggccatgcggcatcccggaaggaataccggtgtaatacagtctggaattgttcagatgctgatcgtatcagcgaactgtgaaaaggcgcactgacattcaaataagtgtatgccgctcccttttcctccgccatcttgatgacacgttccacagcttgccggtgtccggaaatcacatgctgctgttctgaattcatgcaggctactcctgccggaaagtcttccgtcgacactttcgaacatatttcctgcaacgtttgaagagagaggtgagtcacggcggccatcgtcccctgctgctgaggatccgcattttgcataagaattccccgctgccttacaagtgtaacggcatcctgaaaagaaagggcgccggcacagacaagcgctgaatattcgcctaagctatgacctgccaggaagcggggcttcacccctatttcctgcatatacacttgaaaagcaataacactgaccgttaaaatagcgggctgcgcgttcattgtctttgtcaattcattcatatctccgttaaaacacagtttttttacatccaaggagatcgcatcgctcgcttcttcaaacaatctctttgcgagcacaaaatcattccaaaattgtttgcccattcctacaaattgagacccttgtccaggaaataaaaaggcaagattgttcatgagattcctccgatcatattgaacagaaatacaatatcctacaaattatccctttatctaacatcctagcatgattataacaaatgtgtatagaatactttcggaggagttattgttcgattttacaaacgaattagatatatttattcataaaataaaacatggggtttcaccgaaaatcagtcttaaagagagatgatgaaaagccggagtggagcctgttaccggctcttcatcacttaggtcgcgctcttcatgtttcatatgttttagggctattggcattattgtgtcagaaattacatattttatgtttattgtaaaaattcatttgtatatctgtgaaggattgtaaactgatggcgcttgattataaatgcggcgcagaaatggatctggatgagaaaaatctgcaaggacaaaatacgccgcagaacatgtgaatgacccagcccggataccggttgggcagtaaatcggcctattgagtgaacaagtttttcaggcataaaaaaacagccgttcagagcggctgtttttaaaaaaatataagaactattgagcggtatacccgccatccatgactacggcctgacctgtaaccccttttgctttgtcgctggccaaaaatacagcgtaatcagcgatttccttcactgacagcagccgtttttggggaacgagcggaaagatgacgtcctcaagcacccgctcgtacggtacattccttgttgcggaaatgtcctttaactgattgcggacaagctgagtgtccacatatcccggacaaagcgcattgacggtaatgccgtcagccgcgccttcaagtgcaccgactttcgttaaaccgatgacgccgtgcttggcgctgttatatgccgctttcccgtgaaaaccgatcagcccgttgacagacgccatattaatgattcgaccgaattgctgttttttcataatggggaatgcatgcttcattgcgataaatggcgcagtcagcatgacacgaatgagccgttcaaactgttcggtgggaaattcctcgatgggcgcgacatgctgaatgcccgcattattcacaaggatatcgagacgtccgaattgtttctcgaccgtctgcagcatgtcggccacttgcttttcatttgttacatcgcatgtgatgctgactgcttcacagccttcatctttaagtcctgccgccgcttctttccccgcttgttcgtttacatcagagatgatgacggctgctccttcacgggcgaattctcttgcaatttcaagcccgattcctccggctgctcctgttacaacggctgttttttcaataagcaatgaatccatggcggcacctcctcattttggtctgaccccgttttttaacgactggctgacagtaaaatgaccttctgttttctcaaagacctcctccattgttacaccttcctgcagttcggtgagcgtcatacggccatcatgaaaatcgaatacagccaaatctgtgatcagccgatcgaccacctgcctgccggttaaaggcagcgtacattccgttctcactttagattccccatatttattaacatgctccataatgacaataatccgttttgctccgtgcaccaggtccatggcgccgcccattcctttgatcatttttccggggatcatccagttcgccaaatctccccgttcggacacttccatcccgccgagaatcgctacatcaatgtggccgccgcgaatcatggcaaaggattcggcactgtcaaaatacgaggctccctttacctcggtaatggtttcttttcccgcattgatcagatcggggtcctccgttccttccgccggataaggcccgatcccgagcaagccgttttcagactgaagcaggacgttataatcattcggtatctcattggctacaagcgtcggcatccctatccccaagttcacattcattccgtcctttatttcctttacagcccgtttgatcattcgttttctgctatctctcattctgtcagcctcctttatcatgcttgccggacggtgcggcgttcaatccgtttttcatgaatcccgccaagcagcacatgctgcacaaaaatacccggcgtatgaatttgatccggatcaagctctccggcatcgacgatttcttcagcctctgcaatcgtcactttgcctgccattgcagcgagcggattgaaatttctcgccgtctttctgaacatcaggttgcccagaggatcggctttccaggcctttatgatggcggcgttccctgtaatccctttctccagaagataggtgcgcccgtcaaatgtcttatgttcttttccctcggctactgatgttccgacgcccgcaggtgtataaaacgccggaatgcccgcccctcccgcgcgaattctttctgcgagcgttccttggggcaccaattcgacttccagctccccgcttaaaaactgccgttcaaaggttttgttttctccgacataggatgcgaccatttttttgatctgccggtttgcaagcaagaggcctaacccccaatcatcaacaccgcagttattactgacaacggtcaagtttttcacgccgctgtccctgatcgcgagaattaattgttccggaatgccgcacaggccgaagcctcctgcgatgagggtgtctccatccttgatcagtgcagcagcatctttataagagtccatcacttttccttttcccatattcgtttcccctttctgttttggctacacaaggcccgtcagactgtaaatggcgatgatgacaaacacagctgctgttttaatgacggtaatggcaaagatatccctgtaggattggcggtgggtcaacccggtgaccgcgagcagcgtaatgacggcgccattatgcggaagagtgtccattccgccggaggccatcgaaatcacccggtgcatgacctccggcggaatgtggaatgtattgattgcttctgtatatgctgctgacatcgtgcttaaagcgatgcccattcctcctgatgccgatcctgtaatcccggcaagcgcagtggtcgtcaccgctccgttgacgagcggatcagtaaacgtctgcgatatgccgctgctgaccattttaaagccgggaagcgccgcaatgatgccgccaaatccgtattcggctcctgtattcatcgacgccagcaaggcaccccgatgccctcattcagtccttctttcaaattgaagagcacttttttccaatcgaacaaaatcgttgtcatgattccgatgagcagtgcgagttctactgaccagatcgcagtgacggaggaaaggtcaatcttcccgaacgcttttaaaccgagctgcgcaaaatcaaatccgtcagggtaccaatgcgggagccacatcgtgaagcatttgttcatgatccccacaaggataagcggaacaaaggcgagcacttgccgcgcggggctgggttctgcctcctgcggtaaaacaggcgtatgtttttcattagccagacttgaggaatcctctgcagcggaaacttcagattgaaatccagcatagccttctccggcattggccgcttttttgcgccgggattctaaataaatcattccggccgtaagcacaaatgctgcgccaatcagtccgagccagggagcggcataaatgtttgttttaaaaaaagctgtcggaatgacattttgaatttgcggtgtgccgggaagcgcatccattgtaaaagtaaacgcgcccaatgcaatcgtaccgggtatcagacgcttgggaatatcagctttaataaataggtttttagcaaacggataaatggcaaacaccgctacgaagagactgacgccgctgtacgttaaaatcgcacccattaagacgatggcgagaatggctctttttgctcccacaagcctgacgattgtttttgcaatcgactcggcgagcccggatatttcaacaaccttgccaaaaacggcccctaaaagaaatacgggaaaatacagcttaataaatcctaccatcttctccataaatatattcgagaagaaaggaagtacgaagcttggatctgtcaggagcacggcaaacagcgcacaaatcggggcgaataaaatgactgaaaagccccggtaagccgcaaacatcagcatgcctaatgccaataaaataataacaatgtccacaaatccccctcttttctgctcaatattagtaagcgcttacaaagatcaagaaaataaagcagaaaacatgccgattttgcaccgtttctgaggctgaaaaaatgtgcatcatggtgaattttccgttttggcgaaagaaaaggagattcttgctgtatgatattgaatggctgagcagcgagtttttttagggatagtgagatggatcagagaggatttttgctttataaatatgtattcttttttctttcatttatttcctgcaagaggaaccgataaaatccggccctcctgcatggtcattcagccaaggacaaccggaagctctttgagcgacctaaaaccaatgagcttgcggtattcaaggcggtgtgcggccagccgaagcttaggcatccgctcaaacagtgtgagaattgcaatttgtgcttcgatgcgcgctaatgaggagcctatgcaaaaatgggcgttctttccgaatgcaagatgcggattcggttttctttggatgtccattttatgaggctgatcgaatatgcttggatcgcgattggctgcccctaaaaggatatatacctgctctcctttttttatggtcttcccatttatttcacagtcttctgaagcggtgcgtgccgtcagctgcgcggggctgtcgtagcgcagacattcctcgacagcagtttcaataagcgaggggttttctctcagtgcgctaagctgttcagggtgtttcaataaagtaaacacaccgttgctcatgaggtttaccgtcgtctcgtgtccggctatgacaagtaagatacatgtcgcgagcacttcgtcttttgaaagctgttcccccataataaacctgctgattaagtcttcctgaggatgtgctttccgctcgtgaatcaaatctctgaaatatgcagtcagcctgcctgcggtgtcgcttgctctgactaacatctttcttgaccgggtaagatcaatggcctgaatgacgtctgccgtccattgtctgaattgatatctctcctctttcggcactccgagtatctccgcaatgatgaggcttgccaatggaaaggcaaactctgaaacaaggtctgcgttttttttgttttggatttgatccaacaagtcatgaaccgtttcttttatacaggggcgaagtgattccgccgtctttgcggtaaattctttacctataagcatccgcatccgcttatggtctgattgatttttaaataacagcatatcgtgctggatatgagatagattttgatatttcgttgaagcttccggaaaagggacgcggtttttaaaccgggtgtctttcaaaatcgctgccgcttctttatacccggtgacataccagcccggatgttttaatacggttcctttataaacaggatcaatggcacgcagtttttcataaaacgggtaagggtcattccaaaaatccgaatccgcatggagggacggatgtgcagtcgataggcccgccgtcatcttatacctccgtattgcaggcggattgcaggccggctttcatttcttcaacggattcgacttcaaaccctaaatcatggagcatttgatgatcctctgtttcatgctgccctgctgtcgttaagtaatctccgacgaaaatcgaatttgcggcgtaaagtcccagcggctgcagcgaacgaaggttgacttcccggcctcctgagatacggatttcttttgtcggattgataaaacggaacaaggcgagcactttcaggcaatacaccggatgtaattcgcttaccccttctaacggagttccgtcaatcgcatgcagaaaattaaccgggatgctgtcggcgtcaagcgcttttaagctgttcgccatatcaatgacgtcctgtttcgtttctttcatgccgacgatgacacccgaacaaggcgacatccccgattgtttcgccgtttccactgtattgaccctgtcgtcatacgtgtgggaagtcgtaatgtttgagtgattcctttgtgatgtattgatgttatgattgtaccggtctactcctgcctgtttcaggcgctctgcctgttccggcttcagcagaccgaggcatgcgcagatttttaaaccgtaagtttctttaatttctttgacagcatcaacaacttgatctacttctctgtttgacggtccccgcccgctggcgacgatgcagtatgtccctatattcaagtcatgggcgcgttttgcccccttaagcaatatatgcttatccaccatccgataagactcgatcggcgcttttgatattgaagattgtgaacagtacccgcaattttccggacacaggcctgattttgcattcataatcatattcagctttactttttttccgtaaaatcgttttctgatatgaaaagcggcatgcatcagcaataaaagatcctcatcaggacaatttaaaatggccagcgcttcttgattcgttacttccgccccgtccagaactctctctgcaagatccatccattgattcatgtttatctccccatttgtgtcagattcatgaaagaggaaacatctatatgtttctcaatcatgtgttgaatgttttccggtgaaacgtgatccagcttcggtgtgattcccaaaatcggaactttgcataatgtttcaatcatgctcgggtttgtcttctcgtccagccccggccggctctttacgccgttgataataataccgagaacctctattcccatgtttttcgcatattcaacggttaaatatgtgtggttgatggttccgagatcaggcctggcgacaatcactgccggtaattccaaggcttttatcaaatcactgactaagtaattttcaccaagcggaacggaaatgccgcctgccccctcgacgatgaaacactcatgacgatttttgatcttactccagtgggccatgacttcatccatgctcacggatttcccctcaagcatggcggccgtgtacggcgcaagcggctctttccattcaaatggcgtgatttcttcatgagacagtgcggtttgtgacatgtttttcaacagcgaggtgtcactttccggatgagtccgcggcacgccgcttaaaaacggtttaaacactccgatatccgcctgtttctgcctgaatgccgcggcaagtccgcaagaaacgatggtttttccgacgccggtatctgttcctgtgacaaaaaaacttctcatttgtttatattcagctcttttctaatggaatcaaatgcttccgtcagctcgtctatgtcctgtaagctgcgatccgccgtaacggtcagcctgattctgctttcgccttccggaacggcgggcgggcggatggccggggcgcagattccctttttctcaagcagcgcagcggctgaaaccgctgtttttgcatcaccgatgataacggggataatcggtgtatctccgcctcttacagtaaagcccatatcggccagacgcgtttttatctttttgacagacgactgcagctcacggcgcgtatcgtgcatatctgatatgaggtcaaatgccgtatgcgaagccgcacaaattgacggcgggagggccgtctgaaaaataaacgtccgcgcctgattcagcaaaaaatcaataaaaatgtttgatcccgcggcaaaaccgccttccgttcctacagctttgcttaatgtgccgatgacaacatcaggacaaacaccgaaatagtcactggttcctccgccgttttccccgagtataccggttgcatgcgcgtcatctgctatcacaaatgcctggtactgctttgcaagcggcattattcggtcaagaggcgcgatggtgccgtccatgctgaaaacgccgtctgtgacgataaagcggcggttccgagtctggacggaggcaagttttttctcaagatcagccatatcaatatggcggtacacgatggtttccgcttttgataaacggcagccgtcaacaatgctcgcatggttcagttgatcgcttaaaatgacatcgcctttttgaggcagtgaggcaagcacgccgatattcgccaagtaaccgcttgaaaataataaagccgcttccgtctgtttaaagtcggagattttttgctcaagtttttcgtgccacacagtatttcctgtcgttaaccgtgagccgccgcttcccgctccgaaccggctcagcgctgtttgcgcggctgtgatcagccgttcatcttttgacagacctaaatagtcattggacgcccaggtctgccgcttttgccccttggttttaagagcggtttcctgtgttcgcagcgtccgatacagcccgtctcttttcaccgcatcgagccttccgaggagccatccgtcaaaatccacggccggtcacctcggctatcgcttctttcataatggagatcatggcttgtaattggtcggttgtgctggcgagcggcggaagaaaggcgatgacgtcaccgagcggccgtgtcagcatacccagctctctcattttcaaggacaccttgtatcccatccgcttttcaggcggataaggctgttttgtccccttatcctgcacaagctctatgccgcacatcaaaccgagctggcggacatcgccgacatgaggaagcagcttcagatcatgaagaaattccgcagccgtttttgatttttcggcgactcgttcaacgatgcgctctgattcgaataaacgcagattttcaattgccgcggcacagccaagctgatttcctgtataggaatggccgtggaaaaatgttttcattttgtcgtagtcatcgtagaaggcttcataaatggcttctgtggcaaacgtcacagcgatcggcaaatagcctcccgtaatgcctttccctgccgccatcaagtccggctggacgttttcatgctcacaggcaaacatttttccggtgcggccgaaccccgtcgccacttcgtcaacgatcattaacacatcatatgccgtacacagctttcgtacgcctgccagaaagccttcaggcatgacgatcatcccggatgcgccttgcaccatcgattcaatcgtaagtgcggcaatctcttcgtggtgctttgcaagcagctgttcgagcgcgtgaaggcattcatcccggcactgtacggggtcaccgctttcagatctgtatacataaggaatcggggctttgtagctttcaaacatcagcgggccgtacacatggtggaagagttcaatggagccgacgctgacggctccgattgtatcgccgtgatagccgttctgcatcgaaataaacgtctgcttcttaggtctccctacgtttttccagtattgaaaggccattttcagagcgatttccattgcttccgctccgctgtcggaataaaaaacgcgcgtcagcttttccggtgtgatgcccgtcagcatctcggcaagttctgttgcgggaacgttcgtcatacccagcaaagtcgaatgagcgattttttcaagctgtttttgaatcgcttcatccatttcttttttgcggtggccgtgtacattgagccatactgaagaaaagccgtcataatattcttttccgctgatgtctttcagcatgatcccgtttccgctttcaatgatgaacggatcttcatcgtaatctttcatttgtgtgaaaggcagccaaagatgctgtttgcttttttcaatcattgattgtttcatatgttctcctcccgctgaatgaatacaggctgcttctctaaaaaatggatacagctctccgtatctatggagccatcagtaaagaaaacccggcatccgctttcatctccggcattcttcatcttggcaatccgctgatatcccagcttctttgcagcaacgtaacctgttatgtaatcagggtcatctgaccagcacaattcggcaataattcccggatgtgcgcaaacttttgccgcgatggcatgtgcttcttttattcgtgaattttccggcatgttgtgagtaaaagcccatttttgaaaatcaggtgacggccaatccactcgggatacccgcacacctctattccctctgcagtcaatgcgttttcctgcccggatatcaaacaggaccgctcctcttgcttctgcatattccgaaatgttttcgtacgctttctcgatcatgtgcggaggaatccccgccttttgcagaagcttgcgggcgattgcttgtcctttttccggcgtgtctgtttgatggagggcaaccggcaaagggcggatcgtttcgatcggttcatgaacgctttcaagctgaatctgcataaaatcaggtatccctcttgagtgtgagaagcctttatgtaataagccatctaccgcttcctgtaaaccgctgtaagtgatgagccgttctccgccggaaatatgttttccgccctgctcatggggggcgtttcgggaagctctcattctgacgctgtaataggtctcttcctgcatgaaatttccctcctttcttttatttcgaaatttaatgttaaccaaaataataaaaggttaacactaatacagaatattagtgtcttgcacgtaatatgtcaacctaaaatataaaactgttaacttaatgggttttacaaagcctcattacgttttcatgttttgttcatattttagtaattgtttattcaacactgtccgctaaagtaatccatatcaacaaataggacagcgatccgcatcttacttatgaagggaggtcaaaaccggatgccgttatgctgaaagaaaaagtaaagacagcaggccgtttttgcaccgtgggcgccggcaatacgctgatcgattttggtgtcttctttcttctcaccgcttgccttgtcccctatctgccggcgcagatctgctcctattcggcagggatcatcaacagctatgtgtggaaccggaagtggacgtttcgtgtaaaacacaaggctgacgggaaagagatcgtgcgctttctcatcattaatcttgcagcgtcgggaatcacctttttgctgctgtacgcgtttcaaaaaggcggctgttcgcttttggtgagtaagctcgccgccactatcggcggaatgatgatgaattttatcggaaaccgaatctgggtatttggagattcgctgaaaaacatacaggatcaggagtgaagatgaatgagaaaaaaagtgagaaaagcggtcatccccgcagcgggtttaggaacgagatttctgccggcgacaaaggcgcagccgaaagaaatgctgccgatcgtcgacaaaccggccatccagtacattgtcgaagaagcaagagagtcaggaattgaagatatactgattattacagggagaaacaaacgctcgattgaagatcattttgaccggtcggcggagttggaaatcaatcttaaggaaaaaggcaagtcagagacactgaaggaaatgcagcggattgccgatttggccaatattcattacatccgtcagaaagaaccgctcggactaggccatgcggtgctgtgtgcggagcattttatcggagatgagccttttgccgttctattaggtgatgatattatggtatctgacactcccgctctttcacagctcatagacgtctataaccaacacggcacagaaacgatcggcgtacagcccgtcgatcctgctgatgtcagcaaatatggtattatacagacggggcggcagagcggtcatgtgtaccgggttgaggatctgattgagaaaccggccgttgaaaaggcgccctctcatattgccgtgttgggccgttacatattaacccctgccatttttaaagcgctgaagacgatcggaagaggcgcgggcagcgaaatccaattgacagacgcgctgcgcgaagtatgccgcacccgaagcatttacgcgcgggagcttgaaggaagccggtttgatataggagataagttcggctgttttaaggccggcacggagatcgggcttctgcgggaagaaatgagaccgaaacttttagcttatttagaagaggtgttaaaaagagaatctgaagaaatcgtgcgttaaaaaataatttgtaaccattttgcttgtcaatcagtcatataattgggtaaaaagataaagaggttgtgaacagtgtgggcaattttattagtgaaatattatcctggctgacaagtatgggctatttagggattgcgctcggattaatgatcgaaatcattccgagtgaaatcgttctggcttacggaggctatatggtgtcagaaggcacgatcagctttatcggcgccattgtcgccggtgtgatcgggggaacgatcgcgcagtgctttatatactggatcgcccgttatgggggacggccgtttttggacaagtacggcaagtacttacttctgaaaaagcatcatgttgatgttgcggaaaactggtttcgccgttacggcgccggcgttgtgttctcggcgcggtttatcccggtcgtcagacatgcgatttccatcccggccggccttgcgaaaatgcctctttccaagtttgtcatattgacgacgcttgccattattccgtggtctgtcattttcgtttatctcgggtatcagctcggggacagtggaaagacgtagacagctatgccggaatgtatacaactccgatcattatattggctctcgtatttattgttgtttattttgttgtgaagaaaatgagatcaagactgtgaaaaaagactgcataagaacggctgcgagccggatctatgcagtctttttttatttataccgggtatacggggtgtttccggtgtgtgaatgtcagttgtttggacatgtaagcagtgaggcgtttattgagttcttcccgcaaggaatcagcaggaacaatgccgtcaatcaccatttcagaggcaagccggtaaaggttaatgtcttccttatattcatcacgcttttcttgaataaaagccggcctttcttcaggggccagctcgctgattttgtttgcgtagaccgcattcaccgctgcttcaggacccattacggcaatttgcgcagtcggaagcgctaaacagcagtccggttcaaaagcaggccccgccatcgcgtataatccggcaccgtaggcttttctgacgataacggaaagcttcggaacagtcgcttccgccattgcggagatcatttttgcgccatgcctgatgatgcccgcctgctccaccttcgttccgatcatgaatccgggaatgtctgctaaaaacagaagcggaatatggaatgcgtcgcacaaagcgataaattttgcggctttatccgccgaatcgagaaataaaactccgcctttgacacgcggctgattggcgataatgccgaccggctgtccgtgaatccgcgcgagccccgttattaattcctgcgcaaataacggtttaatctcaaaaaacgagtcttcatcaatgacacgttcaattaaatccatcatgttgaacggtgcgttttgatgtgccgggatgacatctgagagcggtttttcaaaagctttcgggttcttagatttgttgacgggcgctttttcagtataatttgccggaaagtagctgagatatgtctgcgccatcatgattgcttcctgttccgtcggggcgaggagatcaccgcagcctgatacagaacaatgcatacgggcgccgcccatttcttcaagcgatactttctcgccgatcaccatttctgccatgcgcggggaacctaagtacatggatgcattgccttcgaccataatgacaatgtcgcaaaaggccggaatgtaagcgccgcccgcagcggaaggaccgaacaataaacagatttgcggaatgcggcccgacagctttacttgattataaaagatgcggccggctccccttctgcccgggaacatgtcgacctgatccgtaattctcgcacctgcggaatcgactaagtacaagagcggacactgaagcttctccgccgtctcctgaatgcggatgattttttccaccgttttcgcgccccacgagcccgcctttacggttgagtcgtttgccatcacacaaacggttctgccgccgatggttccgatcccggtaacgaccccgtcagccggcagtccgtctgacatgcactcggcgaaaaaagcgtcttcaacggatatgccgtcatcgaataaaagcttcagcctgtctcttacaaaaagttttcccttcttttcgttgcttgcatgatatttcgcggctcctcccttttcaatcgttttgctgcgtgtctgccgttctttttcgtaatccatccgagtccctccatgttttattttcctttgtattcagggggtcttttttctttaaaagcgcgcaggccctcttctctgtcaagtgtagggatgacttgttcatatgcttttcgttcgatttcgagccctgtattgagatctgtctccagacccttgtttatcgcggattttgcttgtctgacggcgatcggcccattagcggcgatgcggccggccagtgcttttgctttttccataagttcatcggcttcacaaacatgctcgatcagcttcatgtcttttccctcttcggcagaaagccttcggccggtatagatcaattcttttgccgcgccggggccgataagccggggcagtctctgcgttccgcccgccccgggaatgattgcaagccctgtttcaggaaggccgaggcccgcccggctgacggctgttctgatatcgcaggcgagagcgagttcaaggcctcctccgacagcggttccgttcagcgctgcaatgaccggctgcgggagagcttcaatggatgcagccgtttcaccgatacgcctgacgctttgcttaacttgttcatgattcatcccagctctttcttttaaatcagcgccggcgcaaaatgtgtttccggagccggtgagaataacacagcgaatggatggcgagtttttgatgtcttcaatcacacgctgtaaatgatcaatcatttctgaagacagcgagttggccgcatgcgggcggttcagcgtgatcagaccgatcgtttcttgacagacggaatacaagacgcaatctcccatggcttctcctttctcatttcgttctgaatgcctgcagatttctgcttggcagatctttgcctattttatccgcgatccagcgggcggcatcaagaagtttattcatgtccgtcccggtatcaatccccatttgttcgagcatataaatgacgtcttctgtggcagcgttgcctgctgatccaggggcgtacgggcagccgccaagcccgcctgaggaagtatcgaaggatgtaatccccatatcaagagcgggaatgatattcgctagagccgttcctcttgtatcatggaaatggagtgcgatttttgaggcgggaattctcggcaaaagggcttcaagcacggatatgacctgcaaggggtttgccgcgccgatcgtgtcgccgagcgatatttcatcaacacccatttcgagcagtgtgtctgacaggcggatgacttgttcgaccggcacgttctgttcgtacggacagccgaacacagtggacagataagctctcgtcgccattttttcagcttttgcttcagtaataacccgcctgagctcttgaacggtccggtcaatcggtttgtttacgtttttttggttatgggtttcgcttgcagataaaaatacacaggcctgatcgattccgccttctgccgcatgctccagtccgatgaggttcggaacgagcgccgcgtagaccgtatgttcagacctggcaatgccttttgcgacgtccaggctgtcacgaagagccggaatccatctcggatgcacgaatgatgtcacttcgatatagggaaggcctgtttttgacagcatattgatccactcaatcttatcttctgtatccacccacgccgattcattctgcaagccgtcacgcggtcctacttcattgatgcggacatattccggacagttcatgctgcacctcccgttttattgaagttcaatcaggacctctccttcatcagtgaaatcaccttctgattttttcacttctttcaccgtacccgctgcatcagcgataatcggaatttccattttcatagattccaagatggccacttcctgtccttcttcaatgacatcaccgggcttcacatgaattttccacaggtttcccgccatctgaatttttatgacgctcattttgacgccccctcgttcattgtttgtaaaaaaccggttgttgcctcacccttttcaaacacttctgaatgtgcaatttttgtaagcagcggaatgttggttttaatcccttctacatgatattcgccaagggcggttttcagttgttcaatggcttgttttctcgtattcgccgtgacgatcattttggcaatcatcggatcgtaaaacggagaaatgacgcttcccttttcgacggcgcattcgtgtcgcactgacgggtgtcttaaaacggaaaaagacgagatggtaccgggtgacgggtaaaaggtgaccggatcttccgcatagatccgcacttctatcgcatgaccgcggtggttgatatctttctgcgagaaagtcagcgcctgcccggcggcgattttcagctgttcttccacaagatccagtcctgtaatttcttctgtcaccggatgctccacctgcagtcttgtgttcatctctaaaaaatagatttgtttcttttggtcgacgagaaattctattgtgcctgcattttggtagccgatcgatttagcggctttaacggcggtttcaccgagtctttgtcttaattcatcgtcaacaaacggcgacggcgcttcttctatcactttttggtggcgcctttgtactgaacagtcacgttcaaacagatgaacggtgttgccgaaagaatctgcgagaatctgaatttcaatatgacgggcattttcaatgaccttttccatatacattgcgccgtctccaaaaaaggacgcggcccgcttttgattgccttcgaacgctttggccagctcttcttctgaatgtacgatctgcatgccgattccgcctccccctgcagacgctttcagcataaccggaaagccgatggcacgggcttcggctaaggcggagtgaacatcgggcaatggctctgaaacaccgggaacgatcgggacctttgctttttgcatcgtttttcgggcttctatcttgctgcccatcttggcgatgatatcaccgggcgggccgataaatgtgatttgttccttccggcagcgttcggcgaacaggctgttttctgacagcagcccgtagcccggatgaatggcgtccgctccggcggatttggcggcttctatgattctgtcgatatgtaaatagctttcatttactctcgatttaccgatcggataggcctcatcagccgcttttacatgcagcgcgtccctgtcggcttctgaatacacagctgccgaggggatgccgagacgtttgcaggtgcggataattcttaaggcgatttctcctctgttggcaatcaggacttttttaaacaaatgtgaagcactcctttttcattaagttaacttgagctcttcaatcgttttttcccgcagcttgaatttctgaatttttcctgaggctgtcattggatattcatctgtaaacaaaacatacctggggactttatagcgggcgatatgttctttgcaaaaggttctgatgtcttctgcggaagcggtttgtccgtctttgagcctgacccacgccgcggcctcttctccgtatttcggatcaggcacgccgacgacctgaacgtctgccactgcgggatgccgatataacatttcctcaatctcgcgcggatagatattttcgccgcccctgatcagcatgtctttcagacggcccgtgattttgcagtacccgtcctcgtccatgacagccaaatcaccggtatgcagccagccgtccttgtctatcgcttcttcggtcgcttcttgatttttatagtaacctttcatgacatgatatccgcgggtgcagagctctccttgttcgccccggtcggcttcttgggatgttccgggccgaacgattctgacttcgatatggggaagcgcgcgccccgctgtttccactcttctttcaaatgaatcatccgttcttgtctgcgtaatgacaggtgatgcttcggtctgtccgtaggcaatggtaatgccggtcatccccattttgccgatcacttctctcatgacttccgccgggcatggcgagcctgccataatcccggttcggacgtgggaaagatcatattcagaaaagcggctgtcatttaggagggcgataaacatcgtcggtacaccgtgcagagccgtgcaggcttcttgctccaccgttttcagaacggccggtggagaaaactgttcgatcggaatcatcgccgcacccgcggaaacacatgccagcacgccaagcacacacccgaagcagtggaaaaacggcacgggaatacataaacggtcacttgaagtaagcttcatgcattctgcgatattggccgcgttatttacgatattaaaatgtgagagcatgacgcctttcggaaatccggtcgtacctgatgtatattgcatatgaatgcaatcatcctttttcaggctgtccatccttccgtcaagcgctgcatccgttacagcttcgccttccttcagcaaagaatcccagcggtgcatcccgggcggacttttatcaccgatatataacaccgtccgtaaaaaggggtaacgtttcgaacgcagcctgccgtgctcacaagttttcagctccggaatcagcttattcaccatctcaacataagatgtctgccggtaggaatccatgattatcagggccgagacgtctgaatgcgccagcaggtaatcgagttctgcgatttgaaaatttgtattaatggtgaccagaacagcgccgattttcgccgttgcaaattgcgccgcgagccattccggtatgttggatgcccatatggccacatgatctcctttttcaattcccagtttcatcagcccttttgcggtttgccggcataaccggtcaaactcggcatacgtataacgaaggccgcgctcagggtaaacaaccgcttcatgatccggaaaaagctccgcggtccgctcaagcagctttccggctgttaaatggataagttcagccatatgacctgcccccttccatccctgtcttagtaaacgttttcatttcacttcaaaagctgtcttgcgatgaccattctttgaatttctgatgttccttctccaatctccatcagctttgcgtcacgaagcatacgttcgacaccgcattccttcatataaccggaaccgccatgaatttggatggcctgaaggcaggttctgacggccatttctgaagcataaagcttggcgaatgccgcttctttcgtaaatggcaggttttgatccttcagccatgccgctttaagcaccatttgtctggcaaggtcaatttccatcgccatatcggccagcttaaattgaatggcttgaaatgacgatatcggactgccgaactgcttgcgttccttcgcatatgacagcgacgcctccagtgcgccttgagcgataccgacagccagtgccgcaatcgagatccgcccgccgtctaatgtatataaaaattgtttaaaacctttttcaggatcaccgagcaggttatcggcaggcaccctgacatcctccagcacaagctcggccgtatccgatcctctcacacccatcttgtcgtacggatttgtgatcgtaaatcccggtgtgtctgtcgggacgatgagagctgaaatgatcggttttccggcggagttctttcccgtaacggcggtgacaatgaccgtgcgggcgtaatttgcgtttgtgatccagcatttttctccgtttatcacatagtcatcgccctttttctcggcttttgtctgggtgccgccggcatctgaaccggcattcggctctgtcagcccgaatgatccgagcgcttttcccgaagcaagcggaacaagatgttcttgcttttgctgttcagtaccgaaatagtataatgggcttgcgccgagtgacacggctgccgcgtagctcagccccgtgctgccgcaggcttttccgatttcttcgaccgctgctgcatatgaaatggtgtcaccgcccgccccgccgtattcttccggaaacggaattccgagcagcccgagttcgcctatttttttaaatgtgtctatcgggaagacggctgattgatcaacctcatgggctttcggggcaatttcatttttggcgaaatctctgaccatttcgcgcaccatctgctgttcttttgtcagttgaaaattcattaaccttcctccttctgctgctttctacattttattaatgggggtctttattcattccatccaaataaagtctgaacattcggactcatccgccgcaaaaaaaaactgacagtgccgcaactgtcagttttattaataatggctatttaatcgtccgttttgcggagggacggctctcatggtgaagcctgtcaacggaagtaacgatataggtgcatgcttcttccgcccgaataacagtatctgaaaatgtctgcgtccgtgacgatgtttttctgactgtatccactaaataaggctgctttcccttttctgcgcggtaaatggcgtaataagccgtttttttaccgttggatttcgcatcttcgatatagagtgtatggcctgaagcgttcttctccgcccgtttgacagccggtttttttaaagcggaatgtccgagccaaggcatctcgggaattaatgcgggccggctgtacatgtcattgatcaaacggtttttcacatcgagcggattacggtttaaatcctttaaactgaaatgcatgctgccttttatccatgctgatcctctgtttagcgtaatctgtcttccgtattcccccgggtcggcccaggccggatcagtattgttgttgattttataagctgcctgcccgatatataaatgcaccggccgattgttcacttcttttccccaccaatccgctaagacgtcatatgccgccgctttaaatccgatactccagtaaatttgcggtgcgatgtaatcaatgtatcctttttggatccattctcttgtatcagcatataagtcatcgtagttccgcaccccggcggccgtttcggagcctgtcggatcatctgcggcatttctccatacgccgaacgggctgattccgaatttgacataaggtttttctcgtttgatggtttcgttgatttcttttacaagccggttgacgttatccctgcgccagtcatcaatcgatgcaaagtgagcttttccgtaccgttcgtattccgcctgatcggggaattcctgtccggcaattttataaggataaaaataatcatccatatgaaccgcatcaatgtcataacggctgaccacttctttgattccatccgttataaattgtcttacttccggaatgcccggattatagtacagctgttttccgtatgcagcgacccagtccggatgggaacgcgcgggatgatcatctgaaagcgcattcaaatttgtgtgattcatcgtgatccggtaaggattgaaccaagcgtgaaattcaagattccgtttatgtgtctcttcaactaaaaaagcaagcggatcgtagccgggatttttgccttgggttcctgtcagatactctgaccaaggcccgtaatctgatggataaaaagcatcagccgcaggcttaatttggacgataacggcgttcattcccatcttctgaacgtcatccagcagcttgctgtattctcttttttgctcttccggtgacagcccttttttagagggccagtcgatattggtgacagacgcgatccatacggctcgcatttctctctccggctgagtgccgcttgcttgtgcggatgctgagaacgtaaagatgccggctgtcagtacaacggccaaaaaccatatcatgctaaaacggcagcttttcatgtttttccccctctctgctttacggtattccgaagcattccgggcggtgaatcagaaagcctgctttgctcctctcagcctaaaagggaaagaaaaaagtcctaaagcgaatcaaaacgcttcaggactttttatgttttatggcggcgagcacgtcaatgaccttcgttccgacgccgacgcatgtttcaagaatggcctgcgctccggcaatggacaaaatgaaaataaccggatgtgcatagcggggccagaccaaatagcagatgccgatcaatatggcgcaccagacgcccgcacaccaataacattgcagcatataaccgaatgcggaggaagggacttttttttggacggcgcgcccgttttgatcgacggttttttcttgctttataaagggttttcttatgaattccgtaatcttatcaaatacgatcaaatgggtcagccggtagctggcaagaataatcattacatacgtaagccaagataggttcgtcatctcaaagcctccaaaaaaactgagtgtgattcccctatcttgccctttgtcttcttcagtcattctgccggatgttacagattccgcgccaagcgtcttccgctgtttgcgatgatgtccagtatgacctcggcatttttgtgtgcaaactcgggctcaaacatatctttatgggctccctcgccctgatattcctggtagactcccgttgtggcgccttcccatttcatcggctcggtcttatcactgtgctcttcctttatgccggcctcaataaaatggagatttgccgcaatttggccgtcatttatcagttccgcccagtacgtttgatagcgctctgtttttctgatgaccgcttccctgacggcttccgggacattttcggctgttgcgtttgttggctgcggcggcagtgcgtcaagctttctgtacgcgtctgcgataatgacgtcgctgatttctaagccgcgcttttccatcgcttttgcagcctcgaatgccgtattgccgcccgctgaatatccgaagaggatataagggccttccggctggatttccagcattttatcaatgtattgttccattctgctgtcttcttcaataaagttaaaaccgtacacagcagcccgtccatttaatgccgccgccagatctttaaagaaaatgccgaaacctgagataggcggaaaacagaaaagattgcggcctttcggctgattcagtctgctgatatgctgttcggcagcttctgacagtgtgtttgaatacagcttttcagccaattgttcaattgtcggatattcaaatatcatttcaatcgggacgtccatctgctgcctggtcttcagctgatgaatcacttgcaatgctttcaaagaatggccgcccagctcaaagaagtcatcctgtatgcccagctccccgcagccgaggatcggcgtccaaatgtcgatcagctcacgctctacccagtttcgtggcggaacggcttttgatgaagcttttttccgttccggcgcaggcagcccgcggcggtccactttgccgtttgcggtaagcggcatacggtcaagcttcatcacatactgcggaatcatatagtcgggaagcgacctggccaatagggatcgaatggctctttcttcagcatgtgcgcctgtataatacgcacaaagggttgcttcttgtccttcgtctgacacgatgactgccgcttccctgattccatcaatttcagtcagccgcgcttcgatttcggccggctcgatacgcttcccgcgaatcttgaattgacggtcgatacggctgatgtatccgatgcttccatcaggcagccagtgtgccaaatcccctgttctgtagatcttttcttcaggatgaaccgggtggctgacaaatgcttcacttgttaagtcaggcctgtttaaatagcctttggcaaccccgtccccgccgacacaaagctcaccaggcacgccgatcggcgcaagtccgccatttttatcaatgatatacgcggttgaattgctgatcggttttccgattgggatcggctgagaaaaatcgtgcctgatttcgtaaaaggtagaaaatgtcgtattttccgtcggtccgtatatgttataaaggctgagattcggacagcggtgtctgaccttattgatgagcgccggggacaatgcttctccgccgacatataaggtgtgcaatccgcaaaacatctccggatccgcctgggcaaactggttaaaaagcgccgtcgtcaaaaacagaatcgtaataccgttggaagaaagataattgccgaacctctcaggggcaagcattgtcgtgcggtcaaccacatggaggcacgctccgttcaatagcgctccgaagatttcaaacgtcactgcgtcaaaaccgatggatcctgtcagaatgagacggtccgtcgtgccggctgacgtgtaattgctgtttgacacgagcgatacgacgttgcggttggaaatcatcacacccttcggttttcctgttgaaccggatgtatacataatataggcaaggtcatcaggtgacgtaacggtattcagttttccctcatcagctgtttgtttttcagctgcagccgggatagagatgatgtgagaaaagtcaatgtcagtctcaatccctttttgtaccgttaacagctgtgctccgctctcagtgagcatttcggcgatcctgtcggatggcagttctgcatcgagcggaaggtacgtccctcccgctttcaatacagcgagaacagcgatgataaattccggtgagcgttcggcaagaatcccggcaattccttttggcgccaaaccgttttccagcaggatgcgggcgaacgcagttgaccgttcatcgagctcccggtacgtcatcgtcagcccgccggcgtgaagcgcctgatggtccggggttttcttcacctgtcggctgaacaggctgatgatgctttcgtctctttcatacgttgttttcgtgtcattaaattcgccgattattcttgatttttccttttgtccgagcatcggaagccgatcagcgggaacatcgggattgaaggcggcgccgcgcagcgcttcttccaagtgtccttttacgctctctatccatacttcgtcataaacgttcgcattgtagctgaatttgatgatcagctcatcgccgggcgctatgatgaggttaaaatcgtagcccgattgttccgaaacattgacattcccgatccggaacggtgcatccgattccttttccgcgtctctcatctgctgctgaatcggataattttcaaacacgatgatatggtcgattaaatcctgtttcagctcagtctgagattggatgtcagcaagcggatgataactgaacgcctctgaatcaagcatttctttctggcagcggcccagcagttctctaaagctttcgtcacccgttttaatgcgtaccggcacagtattgataaacagcccgatcatgctttccacgccgtcaatgacggaaggccgccctgatacgacggcgccgaatacggcatcgtccgtccggttgtagcgctgcagcatcaggccccatacagtctgcataagaaccgcgagcgtagcgccctcttctttggcgatggttttcagcctgtctgtcagattttgatctaaagaaaacaggagctctttcttacggtagccttttccctggggacgggccgatattttcgggagtcctgagggtgtctcgcagcttgctaaatatcctttccaatactcagaagccgcgtctttgtcctgatcagtcagccatgtaatatacgtgctgtaaggctttgcgggcgccagtgtgacgggtgagcctgattcaatcgcccggtacatatgcatgaattcctgaaggacgatgccgaggcaccagccgtccataaggatgtgatggtggctccagacgcatacatatttttcctcagccgttttaaacaaagacacacgcatcagcatatccttttgcaagtcaaagccttttaagcggtcacgttccttaaatcgctgtaagtaggcgctctgttccgcttcatccaaatgtgtaagatcttcgcggtgcagccggaattcccgctcacgcagcacgacttggcgggggccgttcagctgagcgacatgaggtaaaaaaaccgttctgaaaatatcgtgacggctgatgacagactgtacgctttgctcaaacaattccggacgaagccggccttttatggtgaagacggattgctcgatatatgcagccccctccttttgcagaaaggaatgaaaaagcattccttcctgcattcggctgaggggataaatattttggatgttttttgttttgtccatgtgttcctcccgctcggtttagtggaagctgagtaagtcggcaatatcctgcaaggcttcctcagtcagctcccgatcatcaaagtcactgacggtcttctccgtatcggttttgctgaggcagtgttccgacagtttcaggagataataccggcagctttcggacagccgttcgatcgtatcttgccggaagcgctccgtttcataggaaatgctgacggtcatccggccttttgccgcaatagcgctgatttcaagtgactgctcccgtttccatgtatctgtgacatcatctccgcctcccaaaggagaaaactgaaacgcgtcaggctgttccgtttctgccggactcccgccgggcgcatcgaattgtccgagataattaaagctgatctccggtgctttcccgaaagtcatcccggcaagcttcggcggtgttaaatatttgaggacgccgtatccgttccctttatccggaatgcgccgcaatgtgtctttaacggttttcaatgtgcgaatttcatattcttcaagaggttcataaactccgctccggacaagcaccgggtaaatggaagtgaaccaccccactgtcctgctgatgtccgcacctgcctgctccgattggcgtccgtgtccttcaagggcgattttcaaagcgtgctgcggcgaccacttttgaagggcaagcacggcggaagccaacagcacatcttgcgtatccgtattgtaggcgctgtgcacatctttcaacagggcgtccgtttcactttctgtcagagtgaaggataccgtgttccgtttttttgcaggagtttgagatagatctgcctgctcgtaaggaagactttctgtttcatagtgttcaatctcccgccaatactccgcctgctgaagaagctgtttgctttcggcataatcggccagctgctccgtatatgttttgaatgacatggttttcggagggagtttgatttcctgtccagaggcggcctgctcataagcagaagccaagtcctccaataaaatccgccatgatatcccgtcgacagcgagatgatggaccgtcagaaacaagtaatcttctgcttcagagcggaacagtcccgcctgtaccagcggcccgttctccaaatccatgtttctctgaagctctgcgacgcggcgttttataaaacgttccttctcatgctcatcgccttccgtttctaatatggtcaggttgtaaagctgctcatctgcgaggtcagccggtctgttgaagaggagaagacctttctcttcgtcttttttgcagacaaggcgcaaagcatcatgatgaacggtaatggcttttaacgttttcctgagagcctcttcatctattgaatttgttctcgtcagcatgacggactggttaaaatgatttgcttccttcatgtcttgtgtgaagaaccatttgtgaaccggcgaccacttcacttctccttctgcaggagcttggctgaccggctgccgctctgtacggacataaggcgccagctctctaattgtcggccggctgaaaatatcttttacggcgatctgttttcctgcctgatgtaatcgggctgatacttgcagggctttgatggaatcgccgcccagttcaaaaaatgattgatccgcggcaatgttttcagttccgagcacttcgctccaaatcgcggaaagctctttttccatgtcgctttcaggctccgtaaatgcccgtccggtgtgcgcttttttccgcggctcaggaagcgcgcggcggtcaagcttcccgttcggtgtgacaggcagggcttcaagtgtttcaaagaacgccggcaccatataagcgggcatttcatttctgagcgcctgctgcacggtttcactttctgttccttcttctgtcacgatataagcgcatagttccgtttggcctgctgatgcggtatgagcggtgacggctgcttctttgacaccttttatgcctgttaaggccgattcaatttctttcagttccacccggtagcctctgattttgacttgctcgtccattcggccgatatattgcagcgtgccgtccggcagccattttgccagatcgcctgtgcggtacatgcgccggttcttctggaacgggtcttggacaaaggcttgggccgtttgcttaggaagattgcggtaccctcttgcaaggccggaacccgaaatgcaaagttctcccgttacaccgatcggctgcgggtgatccccgtttaaaatataaacgtgtgaatgctcaatcgtccggccgatcgtaatgttctcactttgttctatatgtcttgccgctgtagtggcgacgctgttttccgtcgggccgtactcattggcaagctccgtgtgaggacaaactgataaactgcggctgataatgttttggtcgacagcttctccagctaatgtgacaattctgagagactctgcatcccccggctccagtacgtcaagcagtgtacggtacagtacgggaacaatgatcatatgagtgatgcggtaagatgcaagatagtgtttaatggcaagaatatctcttgcttcatcttcggctaaaacggccgctttcgcaccggaaatcagcggtgtgaacatacttgttacaaaaccgtcaaatgaaaatgaaaaaagctgaagaaccgtatctttctcattcagatcataaaatccgcttcgccattgaagggtttggctgacggaacgatgttcgaccataacccctttcggcctgcctgtcgtcccggacgtgtaaatgatgtaagccaaatcttccggtgctgataatggctgaaccggtgatgcgtcttgttcttggatatcctccagtgcgagcacttcacctttaaaatgatcaggcacttgatctattgcgccgtgtacggtaaggagaagcgctgtgccgctgtctgaaatgatatattgcttgcgttcctccgggtattcaggatctatcggaacgtaggcgcccccggctttccaaaccccgaagactgcggcgacttgttccggtgatcttggtatcacaatgccgacggcggcattcggtccgatctgccgtttttgcagagctctggcgattttattcgaccattcatctaattctttatatgtgaccaacgtttccccgctgataagggctgccgcatccggtgtttttcgcgcctgagtgatgaacagttcatgaactgttttttcaggcagctgtttatccgtcatgccgttaaagtccgaaagaattcggtcccgttccgcagcagtcagcatgctgatcgcttgtatagaagtttccggttcacggacaatgtgttcaagcatcgtcataaagtgggaagcccagcgctgcatcgtttctttccggaataaagacgccgcatattcaaacagaaaatgaatctgtcccccgccttcagaagcctgcaaagtgacatcaaatttggaaaccggacgggacacgtccgcaggctgaatatgcaaaccgtccaacagcaattcctcatgttccatattctgaacgacaagcatggcatcaaatagcggattacggctcatgtcccgctgcacgccgagccgttccacaagctcttcaaacgggtagtcctgatgctcatacgcctcaagcgccgcctggcggacttccgccaaataatcggtaaaccgtttgtctcctttcggctccgttctgatggcaagcgtgttgacgaacatgccgagaatcggttcaaggtctttgtgcgggcgcccggcaatcggcgatccgacgatgatgtcttcctgcccgctcaatctcgcgagtaacgtattgtacgcggcgagaagcaccatatacaaagtggagccgtgatcccgggcgatgcggtgaaggccggatgccgtttcagcgtcaagcgtgcacgatactttcccgcccgcaaagcttctgaccgccggacggggcttgtcagccggaagctcaagcaccggaagctctccttcaagtcgcttcagccaataggcttcctgcttctggtacccttctttctcctgaaacgaccgctgccagacggcatagtctttatattgaaggcgcatcggcgcaagcgaacggcctgcgtacagctcgccgaattctttaatcaaggtgttgacggacacaccgtcagaaattatatgatgcatatccgttaataaaagatggcgttcatccgattctttcacgagagccgcacggaagagcggcgcttcttccagacaaaacggccggacgaatgcgtcagctgactcggcctcatcgagctgaaacggtacgctgtcatggatgcgctgcaccggttcgccgtcaggccccgtttcaaaggacgttctgagcgactcgtgccgctccacaagctcccggaacgtctcctccagccggacacggtcaagcgtgcccgtcagttccagcacagccggcatattgtagccgacaccgccgtcttcaagctgttggagcacatacatccgtttctgcgctgaagacaccgggtaggtgtcctgttttttcgcaggctgaatcgcttcatacgggctctcttccaagtcctgaataaccgaagcgagctcttccaccgtcggccgggcgaagatgtcctgtaacggcacctgaacaccgaactctttggcgatgcgggagacgagagccgtcgcttttaacgaatggccgccccgctcaaaaaagtgatcccggatgccgacggggccgtttttcagcacctcttcccaaagggcgcaaagcttcatttccgtgacgttccgcggggcggtgtacgcctgtctgtctgccgctccgccgggagccggcagcgcgcggcggtcaagctttccgctcggcgtgaccggccattcgctcatctctataaactgagccggcatcatgtaggccggaaggcgtgccgcaagctctgcccgcacgtcatcgctttttcgtccttcgatataggcgtaaagcgcggtttcgccgtgttcggtccgggcggtgaccgccgcctcacgaatgccgtcgatgcgccggatcgccgcttcgatttcccccggttcaatccggtagccgcggactttcacctgtccgtctgaacgcccgagccattcgacaaggccgtcttctgtccagcgtgcgatatcgcccgtctgatacatgcgttctcccggataaaacggatcaacgacaaagcgctcctccgtcagctcagggcggttcagatagccccgggccacgccggtccctgcgatatacagctctccgatacagcccggcggcagaagctgtttcttttgatttaaaatatacagccgcatgttatgtccggaactgccgatcggaacattgtgaaattcctttccttgcggcaaatcgaagtacgccgcttctaccgtcgcttccgtcggaccgtaggaatttgtcaattccgttcccggcagaaggtcataaaaacgggaaaccaagtgcgggcccaattgttcgcccccggcaaaaaccctttttaagcaggtctttttgatcggctgttttctggaatttatatattccaagaaagcatgaagcatggatggcacaaaatgagctgccgtgatgcggtttttctccaatgcgttcagtatcatttcagggtctttctcgccgccttgcggaaggagaaaaacagaagctcccgcgatcggccaccaaaacagctcccaaatcgaagcatcgaaagagtatgatgttttatgcaaaatggtgtcggaatcctttaatccataacgcgcttgcagcgagtataaaaagtttacggctgactgatgttcaacctgcacgccttttgggcgtcccgtagaaccggatgtatagatgatataagccaatgaatcaggctttaccggaacattggggttggccgcagcttccgggtttcctgtttgtccgcttttcagagagatcgtttctcccttaaaaagatctggtgcgaaaagttctggttctgccagtaagaatttcacgccgctgtctttcagtaaaaagcgaatccgctcttccgggtaatccggatcaatcggcagatatgcaccgcctgcttttaagacagcgtaaatgccgatcagcatgtcaggagaacgccggcccataatggcagttttatcctccagccttatcccccgtttgatcagccggtgcgcaagctcattcgctctttcgttcagttcctgatacgtaatcgaaatctcatcagttaaaatcgccggacggtccggcgttttttccgcctgttgttccagcagctcatgaaggggctgatgaagcggaaacgctgttttctgcaaggggctgaaattttgaagcagagacacttcttctttttctgacaaaacagaaatatcgtctaattccaaacccggatcagctgcggcgttttcagcaagtgtcgtgaaaaattccgcccatttttgaatcgtttttctctcaaacaaatcagtgctgtattcaaactggcagtacaattcaccggcgttttcggagatgtacagcgataagtcaaatttagaaatcggcaggctgacgtctgccggctgcagttcaagtccggctgccctaagcttctgctgttccatattttgcagcgcaaatgttgtgtcaaacagcggatttcgggacatgtcccgcggcacaccgagcttatcgacgagctcttctaacgggtaatcctgatgctcgtaagcctcaagcgctgtttggcgaatttcctttaaatattctttgaacgtcatgcttccgtcgggacgcgtcctgaaagcgagcgtattgacaaacatgcccagaacggcgtcaaggtcggcatgaggccttcctgcaatcggagacccgacaatcatatcttcctgtccgcttaaacgggctaacagaaccgtgtacacaccgagcagcgtcatataaagtgtgcatttgttttctttcgccagctttttcaactgcgctgtatgtttttcgctgatgacaaatgacacccggtcaccggaaaagctccgcaccgggggacgcggcttatcagccggcaattcaagcacgggaatctccccggcaagccggttcagccagtactcctcttgtttccgatatgcggcgcccgccttaaatgattgctgccagacggcataatctttgtattgaatccgtaacggcggcagacttctctcagcatacagctcactgaattcacgtatcaaaagattgacggatacgccgtctgaaataatatgatgcatgtcagctaaaagcagatgccggtctttttctatttggacaaatcccgcccggaaaagaggcgctttgccgagatcgaacggccggataaacgcttcggctgattgttcttttgtaaatgcaaacggcacttcgtcatgaatcctctgcacaggccggccgtttttttcttcaaaggacgttctgagcggttcatgccgccggatcagctccttgaacacggcttccatcctgtctcggtcaaacggccccttcacctctaaaacggctggaatgttatagctgacaccgccattttcaagctggtgaaggacatacatccgtttttgagcggatgagacaggataagttccttttgcttctgtcttttctatggatgcgaacggattctcttctgcttcaccgatgattttggcgagttcttctacagtcggatagctgaagacatcactcagcgggatttgcacgctgcactctttagctatttttgcaacgagtgccgtcgcctttaatgaatggccgccaagctcgaaaaagtgatcgtgaacgccgatcgggccggtttgaagcacttcttcccatatgcgggtaagcttcagctcggtcacattccggggagctgtatatcgacggcccgctgcgtacgccgaagcttccggaagggcccgctgatcgactttaccgttcgcagtgagcggaatcgcgtcaatgaaagcccatttgaccggaatcatataatcaggcagctctttggccaaatcacttcgcagctgagaaggatcagtcgcttgtgagacgctgcagtaggcgcataattcattttcgcccgactcattcgtttgaatcagcacggcagcttctttcacggcatgatgatttgccagaacggtttcaatttctttcggttcaatccggtaccctctgatcttcacttgatcatctgtccggccgatgtattccatttggccgtccgcacgcagtcttgccaaatctccggtccggtacatgacggcgccctttctgaacggatccggcaaaaatttctcttcggtcagcgccggattgttcacatagcctcttcctgtattcgctccggaaatatacaattctcccgcaattccgagaggctgaagctgtctgtttttgctgagaatatacatcttattatgatggatcggtttcccgatcggcggatgttcaggtatgtcatctcccgcagaaatcgtatacgttgaaaccacatgggtttctgacgggccgtaatgattatgcagctgcataccgtgtaaacggagcgtctgcctgaacaaacgtgagatagtcagctgctccccggccgtaatgacatgcttcacacagcggggaaaagactgtgcataaccttcttcattgaaaagcatcttgacaaacgcagtcgggaaaaacaccacttccgttttgtgctgatcgataaacgaatacagctgagaaacatcccgtttgattgattcgggcacgatacaaagggtgccgccgctcaagagtactgaaaataactcctgatagcagacgtcaaacgccaaagatgcgtactgcagcacatttgtgcaaaaatcaatgcctgtgttcgtcaattggtcagaaagaaggttggccatatttttatgttcgagcagcacgcccttcggtttccctgtcgtaccggatgtataaatcatataaaggaggtcgtccgccgtattaatggattgcacattgcttccgtccgcttccgtcccggcctcttctatatatgtaacctgcagcgtttgttccgcggggagtgactgatgccgctctgttacaacatggatgcagccgctgttttcaataacatatcggatacgctcctttggactgcccggatctatcggaacaaaggcgccgcccgcttttaaaataccgagaacggccgccgctaaagaaggagaacggccgagcatgacgcctaccggctcctcccgctttaatccgcgtttttgcagcagacgggccagcttattagccgattcattcagctctttgtacgtcactgacccgccttcataccggatcgcgatttgatccggcgtttgtgcggcctgccgttcaaacatcgcatgaatcgtgtcatactcaggcttttcagtctcttcagaaatcggcgcaagcagctgctctttttcctcaggagtgatgattacaagcttatccggcgtgatatcaggtttgtcgagaatctgggaaacgatatgtgtcaaatgacctttgatattttcgataaattggcggtcatacatgcttgaatcgtatctcattttcaagtgaatctcgtcacccggcgccaccatcaggtaaaaactgtaattggtttcgtcttccatgctgaaatcatggatgtgaaaaaggtctttcgtgtcccccttgctgttcagtacatcaagctcctgttcaaccggataattctcaaagacgagaatatggtcaattaagccttgttttacctgtgaattcgcctgtatatcataaagcggatgatagctgtatgcctgtcctttcaaagcgtccttttgcacgtttttgatcagcttttgaaacggaatgtccgccccgctgatccggacaggcacggtattaatgaacaggccgatcattcgctcgatgcctttgatttcagacggccttccggaaataacagaaccaaaaaccgcatcttctgtctggttatacgcctgaagcaaaatgccccagagcgtgtgaaaaatggtgctcagcgtgacctcttctttcacggccagatctttcagcttagctgtgtcctcttttgaaaaggaaaacgtcacttcctcttggctgctttcgccggcttttttctgcttcggcagaacagtctgctgctcaaagccttcaaggtatcgctcccagtacgaagcggctttttctttatcttgctccatcagccacttgatgtaggtcccgtacggcacagcgggctcaagcgttaacggtgtccggcggagccgcgaggcgtatatctggaagaactctttcagcacgattccgagacaccagccatccataataatgtgatgaaaactccatatgcacgtatattcacattcaccggtttgaagcagcgtcacccgcatcagcatgtctttttgcaggtgaaatcctttctttcggtctcttcgtttggcttcttcaatatgcttgatttgatcagccttgtttaaattggtgagattttcctcaatgatgctgacgttccgctcttttaatacgacctgctgcggcactgacacgttctggctgataaagatcgttctgaaaatatcatgtctttcgaaaagggcatgaacgctctcttcaaacacgcgggtgtcaaccttccccgttattgaaaaggaggcctgctcggcgtaagcctgtgattccttttgcaggagggaatgaaaaagcattccttcctgcatataagacagcggataaatatcctgaattgcattcttttttgtcatgttataatctccccgtcgcctttttctacagttcctcgacaaaactcgctatgctgtccaaatcatcagatgttaacgttttgctgctaaaatcactaacggttttttctgcttcctctttgcctgtgcagtgcgccataatatcacgcaaatattgctgtaaggtttgcagcagctgttccatcgtttctttgcggaagcggctcggcggatagctcaaactgaagtgcagtttatgttgagcggccatcgcgctcatttccaccgcttgttcccgctgccatgtcggcgtgatgtcgtgcccgctcgcaagaccggataaactgaatgtgggctgatcttctgtatcattgaattgccctaaatagttaaaactgatttcaggcgcttgtctgaagcggattgttttttgttcaggcggtgtcatgtattttaaaatgccgtagcctattcctttatccggtattcttccgagtgtgtctttgaccgtttttacagccgttccaagctcagcgcctgctgtgttcaagtcaatgagcaccgggtacatggaggtaaaccagcctacggtgcggctgatgtcgagctccggcatgatgtgctctctcccgtgcccttccatcgcgatgcgcagtctgccgccccctgtccagtcccgtaaagccaaagctgcggcagtcagaagaacatcttgcgtatcggtatggtaggcccggttgacctgctgaagcaaaacggacgtttcttcttctgtaagcgtaaagcttaccgtttgccgaatgctgtcggctcccgtctgatactgcggtttttcataaggaagtccggcggctgtttcttcttcaataaaacgccaatattcttcttcacgcatcagcttgctgctttttgcgtattctgaaagccttacggcgtattgcttaaacgaatcggtctttggcggaagctggaccggctgaccttttacggcttgtgtgtaagcggcagataaatcctccagcagaatacgccatgacactccgtcaaccgccaggtgatgtacggtgatgaataaataatcccctgaccgggttttgaaccagccggcttttaataacggtcctttttcaatatccatccgctgttggagcgcagccacttcatcttctatttctctttcccaagtatctgtctcagacagatcccaaatgtccaagctgtacagttcatctttttgaataccgtgattgatttgtctgatactttcgttttctgcactgacggtgatccggagtgcatcatgatgaatgacaagatgctccaaggcttgtttgagcggctgtttatgcaatgcgtcagagctgaacatcatgacggactgattgaaatgatttctgttttccatccgctgtgataaaaaccagtgctgaacgggtgtccaaggtatgtctccttccaccggttgctgatcgatgactctttccgctttccggataagaggcgcgagttccttaatggacggatgccggaataagtcacttgccgtcattttccacccatagcgtccgagccgtgcggcaacttggagcgctttgattgaatcgccgcccaactcaaaaaatgaatcctcaatcccgacttgttttgtgccgagcacttcctgccagatcacggaaagctgttcttcaagctcattgcggggagctgtgtacgcggtttgaagcgcgagctccggttcgggcagatttttccgatccaatttaccgttcggcgtaagcggcagcttctcaagttccatcatataggccgggaccatgtaattcggcagttgcttagaaagtgaagaacgcactttttctgtatccatgtccgcctgcagactcatatatgcgatcagttctttattgccggactgcccggttctgactgacacggcagcttctttcacgccgtccaggctccttagtgcggcttcaatctctcccagctcgacccgataaccgcggattttcacttgatcatccatccgtccggcatattcaatcgttccgtccggcagccagcgggctaaatccccggtgcggtacatccgttctccgggaacaaaaggattagggacaaatttttcttccgtcagctcagggcggccgaaatatcctcttgccacaccgtctccgcctgtgcataattcaccgatgacgccgatcggctgcggtgttcccctgctgtttatgatatatgcagttgaatttccgacagggcggccgatcgggattgaatgatcgtatgattgttcaatcaaaaagcaagtcgagaacgtcgtgttttcagtcggtccgtatccattccatattgaaagatgcggcagcgttttccgaacccggtttacatgacttggggacagtgcttccccgccgataatcaatcgggataatccggaaaacacgtgttcattttgttctgatagatgattgaacaaagacgatgtcagccacagtgtcgtaatgccgttttgctgtataaatgtttccagaacatcagagtcgagataggtttcctggtcacttacatataaagaagcaccgtttaaaagcggaccgaatatttcaaatgtcgttacatcaaatcctaatgatgaagtaaacaacagtctgtctttcggcgtaaaatcaatataattgctgtttttcacaagacggatcacacttcgctgttcaatcatgacgccttttggcgcacctgttgacccggatgtataaatcatgtaggccaatgattcaggtccgccgagcggttcgggattttccgaacttaagccggcctttgtttgaatatcctctatgaataaacgttttccggaaagcggcagaccgtcaagtttatcagattggagaagaatatcagctttacagtctttaagcatccattcagcccgttcccgaggcacatcgtcaccgataggcaagtaggcgcctcccgcttttaatattccgaggattccggaagcaagctctgttgtacgtccggttaataaggcgacaacactttccggaccgacgccatttgatcggagagccgccgctattctattagcccgttcgttcagctcacggtatgtcaagatttgtccatcatatacaactgcccgggcatcgggggtttcttcagcctgccgctcaaataaacggctgatggtttcgtgtcttgggtaatcgcttttcgtctgattaaactgataaataacgcgatttgtttcagcatcatccagtacgtgaatgtcaccaagcggtattgtttggtcttcaattacttttgtaagaatacgggtaaaataagaaagccatttttcgattgtctgtttttgatagatatctgtattgaattcaaaatcaaagctgatggaaccgtcagacccttctgccgcgtaaagcgtggcatcaaactttgcggttttatgacctgcatccgcggcttgagtcaaatgcagctcatttaaattcagggattcacgctccatattttggagcacaaacatcacgtcaaacagcggattacggctcatgtcccgctgcacgccgagccgctccacaagctcttcaaacgggtagtcctgatgttcatacgcctcaagcgccgcctggcggacttccgccaaataatcggtaagccgtttgtctcctttcggctccgttctgatggccagcgtgttgacgaacaccccgagaatcggttcaaggtctttgtgcgggcgcccggcaatcggcgatccgacgatgatgtcttcctgcccgctcaatcgcgcgagcagcgtattgtacgcggcgagaagcaccatatacaaagtggagccgtgatcccgggcgatgcggtgaaggccggatgccgtgtcagcgtcaagcgtgcacgatacgctgccgcccgcaaagcttctgaccgccggacggggcttgtcagccggaagttcaagcaccggaagctctccttcaagccgcttcagccaataggcttcctgcttctgatatccttctttctcctgaaacgaccgctgccagacggcatagtctttatattgaaggcgcatcggcgcaagcgaacggcctgcgtacagctcgccgaattcttttatcaaggtgttgacggacacaccgtcagaaataatatgatgcatatccgttaataaaagatggtgttcttccgattctttcacgagggccgcacggaagagcggcgcttcctccagacaaaacggccggacgaatgcgtcagctgactcggcctcatcgagctgaaacggcacgctgtcatggatgcgctgcaccggttcgccgtcaggccccgtttcaaaggacgttctgagcgactcgtgccgctccacaagctgccggaacgtctcctccagccggacacggtcaagcgggcccgtcagttccagcacagccggcatattgtagccgacaccgccgtcttcaagctgttggagcacatacatccgtttctgcgctgaagacaccgggtaggtatcttgtgtttgcgcaggctgaatcgcttcatacgagctttcttccaagtcctgaataaccgaagcgagctcttccaccgtcggccgggcgaagatgtcctgtaacggcacctgaacaccgaactctttggcgatgcgggagacgagagccgtcgcttttaacgaatggccgccccgctcaaaaaagtgatcccggatgccgacggggccgtttttcagcacctcttcccaaagggcgcaaagcttcatttccgtgacgttccgcggggcagtgtacgcctgtctgtctgccgatccgccgggagccggcagcgcgcggcggtcaagctttccgcttggcgtgaccggccattcgctcatctctataaactgagccggcatcatgtaggccggaaggcgtgtcgcaagctccgcccgcacgtcatcgctttttcgtccttcaatataggcgtaaagcgcggtttcgccgtgttcggtccgggcggtgaccgccgcctcacgaatgccgtcgatgtgccggatcgccgcttcgatttcccccggttcaatccggtagccgcggactttcacctgtccgtctgaacgaccgagccattcgacaaggccgtcttctgtccagcgtgcgatatcgcccgtctgatacatgcgttctcccggataaaacggatcaacgacaaagcgctcctccgtcagctcagggcggttcagatagccccgggccacgccggtccccgcgatgtacagctctcctgccacgcccgcaggctggatggttcctccgctatctaatacatacagacgggcacccggaacgggttttccgatcggaagccttgtccgtccgctgtcccgttttcggtcacagacgtaaaacgccgcatcaaccgtcgcttccgtcggtccatagccgtgaataagcatggtctccggcagaagatcggcaaaccgggcagccgtaagcggggaaagagcttcccctccggcgaacacgcgtgtcagtgttctgccgaggcgtgttcttgtttccgcaggctctgtttccagcgcgtctaaaaagctgttgaccatcgccggaataaaatgcgcggtcgtcaccttttctgaggcaaacgcttcaatcatccgcacaggatctttctcccagccggccggaagcagatacacggaggcgccggacatcgtccaccaaaacaattgccagatggaggcgtcgaatgaaaaggatgatttcagcacgataatatcctcttccgttaacggaaactgcccttgcatccctgataaaaaggcggcggcttgacggtgttcaacagccactcccttcggtgttcccgtcgaaccggacgtataaatgatataagcgagcgaatcagcatccgcttcttcagagacagcccctgtctccgtctcatttgtcagagaagaaagagacacttctagcgtttcaccggaaaaaccggaaacggataaccccggctgtgcaagcaggagacaagcgccgctgtcctcaagcatatatcgcagcctgtcctcaggatactccgggtcaagcggcacgtaggcgccgcccgcttttaacacggcaagcactgaaaccgccatctccggcgagcgttcagcgagtacgccgaccatgctttctttgcggacgcctttttgtcggagccggacggcgagcctgtccgtgtactggtcaagctcagcgtacgtcagcataccgcccggaaaacggagcgccggacgatgcggcgaaagcgcggcgcggcgggcaaacagcccgtgaagcgtcggagccggcggttcaaccgcttctgtatggttaaatgcatccatcatacttctggcttcacacgcatccagcaatgcgatctcggaagcgccgatttcagggtcggaaatgactgagttcaccatatgccgtaaaaatgtttcgatattcttcataaaaacatcgtcgtatataccggtatcaaattttaagcggatataaagagaattgcccggaatcacctttatgctgcatccgtagtttgtgacttcttccatcgtaaaatcctctaccgcaaaatcaaatgaaccggcctgactcacattttcaatttcacgctgggccggcacattttcaaacacgataatgtggtcaaacagcgcttgcttcagagggctttgcgcctgaatgtcatacagcggataatagctgtacgcttctgcttgcagcgtctcctgctgcaaatgcctgacaagctccagaaaagaaaatgaaccgcttttcacccgtacgggaatcgtattgataaacagtcccaccattttttccacgcctgcgagatccgacggccggccggaaacgacagaaccgaaaacggcatcatcacagcggctgacacgctgcagcaaaatgccccacagtgcctggaacactgtattcagcgttgctcccgcccttgccgcaatgttcttcagctcatttgtctgctcttcagaaatggtgaaaaccgcctgctcaagttcgccgtttggttccgcggattttttcggaagagacgccgtttgctcaagatcggcaagtctcgttttccaaaaaatctcggcttctttacgatcctgcttcatgagccatttaatatacttcccatatggctgaacgggctcgaggaacggaagccgttcgtctccgagagattgatagatcatcagaaattccttcatgacaattccgaagcaccagccatccatgacaatatgatgatggctccatatacaaacatagcgttcaggcgcttttttcaaaatggagactctcatgagagggtctgattgcaaatcaaagcctttatctttatcttcttttctaaaccggtcggcatatttgtcttgtgccttctcgtccaaatgagaaatatcatgaaactgaacgcggctcggcctgtttttcaacacgacttggcggggctttgccacattcttgtgaataaatgtcgtacggaaaatatcgtatcgttcaaaaacagtgtctatacttttttggaaccgttcccggtcaagctgtccgctgatcgtaaacaccgcttgttcgaagtaggctcttgagtcatgatccaacagagaatgaaaaagcatgccctcctgcataaaagacaaaggatatatatcttgtatttccggttgctgccccattgcgccactccttttctatagtttgttgacggctcccataatgtcactcagatcttccagcgttaactcctcgtcactgaaatcagcggcgctccattcacgctcctctttgcctgtgcaatgcgtgataatctgcttgagaaaggtatgaaaatatcccgtcaaaacttcaatcgtttctttttgatactgaaaacggttgtacacgacatgcatgctgagacattccgacgatacggagccgctgatatcaagtgtgtacggacgttcccagtctgggctgacttcatttcccgcttttacgggagaaacaccgaagccgctggaacggatttcccggtcaaactgtcccagatagttaaaactgatttcaggagaatcagattcagtctctccccagagtttgcttatatatttcagcaccccgtatcccgctcctttatgcggtatgcggcgcatcatgtcttttgtccgcttaatgtgatagccgagacgctcgccgtcatcaggctgatcttgaaaacttgcgtcaaccaataccggataaattgacgtaaaccagccgatggttctgctgatatcaagatgctccaggtgctcttcccttccgtggccttccatgctgattttgaatgtctcgtttccggtccatctgttcagcgctaggcttaacgcggcaagcaataattcgcccgtctctgttgtgtatgctctgttcgcttccgttaacagctgctcggtctcctgttttgtcaatgtaacggtcatcacatctgtatctttcagaagattggaagagatgcgggcatctttcggaagcggtttgaccgccgctttttctctttcggaccagtagtctgcttcctgtaacagccggcggctttttgcataatcagagatttgcttcgcgtaagtctgataggaatcggtttttgccggaagcgcggcttcttttccttcgagcgcctgcctgtagcacgcggtgagatcttcaaataaaatccgccatgacactccgtcaatgacaaggtgatgaatggaaagcagcagatgatcgccatcattagcgtgaaataaaccgacagctacgagcggacccgtctccagccgaatggaagtttgaatgcgggcggccgcctgttcaattgcggcgtgttcctcttgtaataaccctttccctctcacgtcatgcgtttcaaatgtaaagagttcttcttcagaaaggttatccgctctgttatattgaatcactgatccgttttgcgtgccgcataccatccgtaatgcgtcatgatgaaccgcgagctgtgccagcgcttttctcatagcagattcattgatcctgtccgcactgctgagcataacggactgattaaaatgatcatgcggcaatgattgcgaaaagaaccagtgctggatcggcgtcagcggcacgtctcccgtgacgggagcctgatcaatcacgcggcggactttccggagccgcatcgagacttctcccagtgtctgatgctcgaacagctcgcggacggtcgtttcatagccctgctgtttcagcctcgcacatacttgcagcgctttaatcgaatccccgccgagatggaagaaatgagcattggggccgagtccttcaacacctaagagttcttcccagatgtcagccatcatttcttcagtttcatttctcaggctgatatcatctccaaggctttcatttaattcaggctgcgggagcgccttctcgtccagcttcccattcgccgtcaaaggcagttcatcaagctctatcaagcgggcgggaatcatatattccggcagaaaagctctgagagaggcctgaacctctgcttcttttattttttcattcccgtgtaagaccgcgtatgcgtaaatggagtgctgaccgtgctgatcagcacgtgtgatcacggcggcctctttcacgaaggaaagctcctgcagcgctgattttatttctcccagctcaattctgtggcctctgacttttacttgcgcatctttccgcccgacatattccagctcgccatttgagagtcttttggcaatatcgcccgtccggtagagccgcatgccggtaatgtgcggattcgtgatgaaccgggaggcggttaaatcatccctgtttacatatcccctcgcgacgccttccccgccgatataaagctcacctggaattccgatcggctgcggattcatataggcgtccatgacaaaagcatggagggtttccagcggtctgccgatattgcttttatttctctcaatatcatccatattcagttttttgcatgtgacgtgaaccgtggtttccgtaatgccgtacatattaacaagctctgtctccgggtacttctctttccagcttttcagcatgccgggctggagcgcttctccgccgaaaatgacatatcgaagcttcagcttgtccgcatgcccggcttcttcatgaatgagtccggaaaaagccgtcggcgtttggttcagcaccgttacgccttcactttgcagcagctgccggtacaaatgcggatcacgggcagtttctttcggcacgataactacctttccgccgtataagagcgcgccgaatatttcccagacagaaaaatcaaagcaataggagtggaacagggtccagacgtctccagtgccgaaatcaaacggcagtcctttatgtgtgataaggctgatgacattgcggtgctccgtcataacgcctttcggttttccggttgtgcccgatgtgtaaatcacgtaagccggctgttcaggcgttatcatttctttcgttctgtctgctgaaacggattcaggcttatcgatgtataaaaccggcagcccgtccattccggatatcccaagacccgattgcgtcaacagaacacgcgcgccgctgtcagtcagcataaatgaaatccgctcgtcaggatagtcaggatcaatcggcagataagctcctcccgcttttaaaataccgaaaatcccgatcagcatttcaggagatcgttcggtcataattccgacaatctgtccggagcggatgccgttttccgacagcatatcggcgattcgatccgccttttcattgagctcgcggtaggtgagacgctcatcggacataacggctgcaatttgatccggcattttttccgcctgtgcctcaaataaactgacgatcgtctcatgcctcggatactcagctgtttgattttccgcttgaagaagcatctgccgctcatttgtgtccagcaaatgaatgtcagacagcttccgctcatcatccgatgcgatttgtcctaaaagctctttaaaatgaccggcccaccgttcgatcgtacctttttcaaacaacgcggtactgtattcaaaatgaaaatccagtgagccgtccggccgttcctcggcatgaagcgtcaagtcgaattttgaaatgtcatgtttcactgcatgtgaagaaacggataagcccggaaggttcactttgaaatcatcactgttttgcaaaacgagcatggcatcaaacagcggattgcgattgacttcccggtgtgtatcaagcttttgggcaagttcttcaaacgggaagtcctgatgttcggctgcgccgagggcgagcattttcacctcttctaaataagcgcggaatgttttatcccctttcggcctgcttctcattgccacggtatttacaaacatgccgatgaccccatcaagctcagcgcggcttctgccggccgcaggtgaaccgacgacaatgtcctcctgcccgctcaatttagaaaggaacaaggagtagcctgccaaaagaatcatatacagtgtcgaacccgtctcatccatgagccggcgcaaattctccgccgtttctttttgtaggcgcgttcgaacaacggacccgctgaaatcaggaagctgcgggcgctttttatcgagcggcagatcaagaaggggaatattttccccgatcgcatccagccaataccgctcatgtcttttgaattcttcagcggcgaaccgctcatgctgccagacggaaaaatctttgtactgaagttttaacggccgcagctcttttcctctgtacaaatccgtcaattcttggatcagaacgctcattgacacaccgtctgcaataagatgatgcatatcaagcagcagaaaatgacgttcttcagtggctttggctaaagtcactctcaaaagcggcgctttttccacgtcaaacggtttgacgaaagtttccatcgcctcttgaagaagtgtcccggatggcatgtgaatctctgtgagatcgagatcgacatgtgaatgtacgtgctgcatcggctccccgtttcgtaaaacaaatgatgtccgtaacgcttcatgcctttgtaacagcgctgaaaaggcttcgtgcagacgatcacggttgagtctgccgctcagttccagacaagcgggcatatgatagcccgtactgtccgccgcaagctgatgaagggcataaagccttttttgcgcaaaagatagcgggtacaagtcctttgcctccgcaggcgtgatttctgcatattctcctcttttcctctgttctaggaagcgggccatgctctcgatggtcggatgttcaaaaacatggcggacggcaagttcaatttgcagccgtttatgtatctttgaaacaagcgacgcggctttcagcgactgtccgccgatttggaagaaatcatctctcatactgatgtgttcccgtttcagcacttcttgccaaatagacagcagctcagtctcaagcattgtgcgcggagcttgataatcaccggttctctcggcttctttcggctcaggaagtgcggcccggtcaagttttccgctcacagacagcggcatttccgtcaatttggtaaagcttcccgggatcatataagcaggtaatctcccggccaattcggcatgaggatcaaatgtcacacccgcgttttccagtacggcataagctgcaagctcctgttccccgtccgccgttttgcgcacgatgactgccgcctcttttaccccggacagacttctgagtgccgtttcgatttctcctaattcaattctgtaacctcttaccttcacctgatcgtcaaagcgtcccatatattcaatcgttccgtccggtaaaaatcgggctgcatctcccgttctgtacagccgttcacctttacgaaacggatgaggggtaaagactttgtccgtcagctctttttgctgaaaatatccgtccgccagaccttttccggaaatacacagttcaccgacggctccgaccggttgcagccgatctccgtgcatcatatagacagaagtgttggcaatcgggcgcccgatcgtaatccggctgcttttttgcaggttgcgcagaatcgtcgtggccacactgttttccgtcgggccgtattcattcagcagctcggcattcgggcatatgttgcggctcgcttccacgatatcaggagtggccgcttccccggcaaatgtcaccgcccgaagcgtctgcgcatcctttttcgtcagcgaatcaagcagaacgcgatacagagacggaacgatcagaagatggcttaccccgtggcgggcgattttctgttttattgaaaggacgtctttcgcatcatcttcatcagttaacagtacacaggcgcccgacagaagcggagtgaaaagactcgttaatgacccgtcaaatacgtatgaaaaaagatgaagcgctatgtctccttctgtcatcccgtattcttcacgccgccattgcaatgtattgctgatcgctttgtgttgtacaagcacccctttcggccggcctgtcgttccggaagtgtaaatgacatacgcccaatttccgctgtcagacaccggcggaagcggtgcagtctgctgggaaaccgtttcctccatgatgacgacgctccccttgaaatgcggcggaatgagggggagcaggtctttttcagtcaggagcagtgaggcttcactgtctctcagtaaaaatgaaatccgttcaggcggaaattccgcatcaatcggcatataggcgctgcccgacttccaaattccgagcagagcggcaaccgtactcattgatcggcgcagcataacagcggtgatctgatctgaacgggcgcctttttcccttaacgcatgggcaatctgatttgcccgctgatttaatttcttgtagctccagcttaccccgttatatctcaacgcctcttggtcaggcgtttttgccgcctgttcttcaaacagcccatgaacggttgtctcagggtacggacggttcgtttcgttaaacgaatgaatcagggcttcttcctccggtggtacgagactgatgcttgataaaagcctgtccggatcttccgttacacaggagatgacctctagaatatgccctttgatccgtttcatgtcttcccgatcgtagatgcccgcattgtagctgaatttcacataaaactcttctcccggaacgatgacgacgttaagatcgtaattggtttcctccgccatcgaaaagttttcaagtgagagcgcatggctttccgtttgctgccagccgtttaccgcagcctgcatctgaaccggataattttcaaaaaccaggatgtgattcaagagatctttttgcaggccgctctcgttttgaatgtcataaagcggataatagctgtgctcttccgcagcgagtgactctttttgcacctttttgagaagagaagaaaaagtcatatcaccagccgcgcgcacccttaccggcacggtattgataaacagtccggccatggattcaatgccgctgatagctgaaggcctgccggaaacaaccgaaccgaagacggcatcttcagtcccgttgtaacgatggagaagcagaccccaaatgcccgtaaatatagtattcagcgtgaccccgatgcctcgggcaatgtctgtcagtttttgtacggtttcaggctcaagggaaaattggaaatgctcagatgcataaccgttttgcgccgtcttattcttcgtttgcggaacggaaacggtttctccgtaatcttccaagcagcgcgaccagaatgctgacgtttcttctttattccggcttcggagccatttgatataagtgctgtaaggagccggactgccgaggtttacaggccgcccgctccggatcgcataatacatgctgaagaaatctttcagtacaaggcccaagctccagccgtccatcataatgtgatgatgagtccaaacgcacgtatggcggttttctcccgtttgaaaaagagtcaggcgcattaaggggcctttttgcagatcaaaccccttatgccggtcggtttccttgaatttgtcaatgatgctttgctgccgttcttccgaataatctgaaatgtcttcagtccgtacggcagtgtcacggcgtgaaaggacaacctgctgcggcccttcaaggtcaggcacttcttttatgaaaatcgttctgaaaatatcataacggctgacaagcatatccagacttttttggaatgtatcaatgcataaatccccgctgactgtaaacgaaatctgctcaacatatgcgtttgatccggaatccagaagcgaatgaaacagcatgccttcctgcatatatgataaagggtaaatatcttgaatttctgtcgcttgtgtcacgaatgccacacacctttttatgaaattaaagtccttttacgagatcttcaatgcttgatagggcttgagcggtcaattctgtatggctgtaatccgttaatgttttttcccgctctttcttgccggaacagtgggcgatgatgtccccgaggtgagtatggaaacgattcatgaagaactcgattgcccccggtgcaaatacatcggtataaacggcttttacctccagttgcccggccgccaccatcgcgttaatatccagatcaaactcgcggatgcgcccggccgctatatcatgctgcggcttgaacggtgacatcttcagcgtcccctcaagaccgtcaaacgcaccgagatagttaaagcttatttctgggtctttataaagaatgtttcgcgaatatctcagcagcccgtagccggttccgtgatgaggaacccgtctcatcatgtcttttaccgtctttatgcggtgcgcggttgtttcccctgagccgtccggcactctcatatccaaaagcaccgggtaaacagatgtaaaccagcccgccgttcttgacatatcaatgtcaggaatatgcccctggcgtccgtgtccttcagtgctgataaggatctgttcggaacccgtccactcatgaagcgtcattccaagcgccgttaaaagcaattcatgaacatccgttccgtacgcctgctgtgtttccatcagcagctgcttcgtgacttcgctgcttaatatccatgatgcagtgcgcgcgttttcctgcaatcgtccggcgttttcatcagttattttcggcagcggcgctgtttcaccagacatcacgctgtcccagtatgcggcttcctccagcaatgctttgctcttggaaatgtcaaaaagctcttcggcatactttatataagaatcgcttttcggcggcagttcgatttgtttgccgtccaatgcctgctgatatgctgtctgcagatcttcaagcaatattctccacgacacgccgtccgtgataaggtgatgaatcgtgatgagcagatggtcggcttctttcagcctgaacactccgagatgaagcagagggccttgatcaaggcgcatagcctgctgtatttctttttcctcagcggctatccgtttttccggctgtgtttcttctgaaagatctatgacgttaagcgtaaagatttcttcatgctgctctgtgattccgcggttatattgaacaacttccccatgctcattttcagtgaaagtcattcgcagcgcatcatgatgttctgtcagcgcgcaaaccgcctgatacagcgcatctatttcgaggctgtcttcactgcacagcatgactgattggttataatgaagctcaaacgcacccggctcctcaaaaaatctctgctggatcggtgtcagcggagcgcttccttctatcgggccctgatcagccgttgcaacagccggcgtgaggtgcttcgcgagttctgcaatcgtcgggaactgaaacaaatcgcggatcgacatgttccagccttctccggcgagtcgggctgacacttgaagcgccttaatggaatctcccccaagctcaaagaaagagtgatgaattcccgctttctgaatatgaagcacatcttcccaaatccggcataacatcgcctgtttttcatcgccgggcgcgacaaatgcctgtgatgaatgtatctcttctgccggcaatgccgatttatcaagtttgccgttcagtgtaaggggcatgctgtctaaaccgataatatgagacggcatcatataagccgggagctcctgcataagagactggcggagtgatgagatatcggcctctttaggaacgacgtatgccgctaatcgtgcttgtccttcggcatctttcatcacggtaacagccgcttctttgacttgatcgtgtttcaaaagcacactttctatttctcccgtctcaattctgtagcctctgatcttcacctgcttatcgatccgccctttaaaacgaagagttccatccggcagccagcaagcctgatctccggttctgtaaagcgtttctcccgtttgtaacgggtcactgaatgcgtcctctgtcagctcaggctgtccccaatatcctttggcgacgccggcgcctccgatatacagctctccgaaaacgccgatcggctggacctgtttgtctttgtttaagacgtacatttgcacattcggaagcggaacaccgatcggcacatcatcttcccgcggctcttcgctcatttcggcttcataatacgaagagtcaattgtcgcttctgttacaccgtagctgttaatgatccgcatttctttcccaaagcgttcatgaagcgtataaaaatcttgcgacttgatcatatctgaaccaagtaccagtatttttacgctttgcagcgcgagtttccggcggtatatatattccataaacggaacaatcagcgcgggtgtcgactccataaacgtgatacggtgctgatcaatgagccgataaagctgctgcggctcaagccggacgtcatccggacaaatgacaagcgttcccccgtttagcagggcgcgtgctagatcccctgaaaatacatcaaatgagaaactcgccatctgcagcactctgaccggtataagatcaagctcataaatcctgcgccatgcaagtgctgcatgcgtaaagctgcgatttctgacttcgactcccttcggcgttcccgttgttcccgaagtatatatgatatatgcggtatcatccggtgacgctgtcggctgaatattctttgcggaaatatcgtattgatcttcatgatcaagctgaatgagaaataaattgtgatccgtcagctgtgaagcaagttctttgtattctgactgcaccatcaagacggatgccgcgctgtcttttaataaatagcgaatccgttcctcaggataatgggagtcaaccggtatatacgctcctcctgatttcatgaccgcaagaacactgacgatcgcttcaatcgaacggtttgctaatatggctgctctttttcccggaccgaatccatttttctgcagtgttcgggcaagacggtttgcccgctcattgagctggaaatagctgatctgttgtgctccttcaataacagcggtctgatgaggcgtttcttctgctttctcttcaaacagctggtgaaacagtttgtgtttttccatgaattcggtttgtgtgttattaaactcaatcagtaacttttgtttttcttcttcatccaaaatgtcagctttcgatagtgtgacttccggttcggcggcaacatggcgcaagagattcagtaagtggcccatccagcgttcaatcgtttctttcataaaaagctcggtgctgaattccatctcaaagcggatgtttccatcggattcagccgctgataaggtcaggtcaaaacttgatacatcatgttcggtatgctttgatcgtgacgccttcagaccggccagatttatctcctcccgctccatattctgaagaataaacatcacatcaaacagcggattgcggctcatgtcccgctgcacgccgagccgctccacaagctcttcaaacgggtagtcctgatgttcatacgcctcaagcgccgcctggcggacttccgccaaataatcggtgaaccgtttgtcccccttcggctccgttctgatggcaagcgtgttgacgaacatcccgagaatcggttcaaggtctttgtgcgggcgcccggcaatcggcgatccgacgatgatgtcttcctgcccgctcaatcgcgcgagcagcgtattgtacgcggcgagaagcaccatatacaaagtggagccgtgatcccgggcgatgcggtgaaggccggatgccgtgtcagcgtcaagcgtgcacgatacgctgccgcccgcaaagcttctgaccgccggacggggcttgtcagccggaagttcaagcaccggaagctctccttcaagccgcttcagccaataggcttcctgcttctgatatccttctttctcctgaaacgaccgctgccagacggcatagtctttatattgaaggcgcatcggcgcaagcgaacggcctgcgtacagctcgccgaattcttttatcaaggtgttgacggacacaccgtcagaaataatatgatgcatatccgttaataaaagatggtgttcttccgattctttcacgagggccgcacggaagagcggcgcttcctccagacaaaacggccggacgaatgcgtcagctgactcggcctcatcgagctgaaacggcacgctgtcatggatgcgctgcaccggttcgccgtcaggccccgtttcaaaggacgttctgagcgactcgtgccgctccacaagctgccggaacgtctcctccagccggacacggtcaagcgggcccgtcagttccagcacagccggcatattgtagccgacaccgccgtcttcaagctgttggagcacatacatccgtttctgcgctgaagacaccgggtaggtatcttgtgtttgcgcaggctgaatcgcttcatacgagctttcttccaagtcctgaataaccgaagcgagctcttccaccgtcggccgggcgaagatgtcctgtaacggcacctgaacaccgaactctttggcgatgcgggagacgagagccgtcgcttttaacgaatggccgccccgctcaaaaaagtgatcccggatgccgacggggccgtttttcagcacctcttcccaaagggcgcaaagcttcatttccgtgacgttccgcggggcagtgtacgcctgtctgtctgccgatccgccgggagccggcagcgcgcggcggtcaagctttccgcttggcgtgaccggccattcgctcatctctataaactgagccggcatcatgtaggccggaaggcgtgtcgcaagctccgcccgcacgtcatcgctttttcgtccttcaatataggcgtaaagcgcggtttcgccgtgttcggtccgggcggtgaccgccgcctcacgaatgccgtcgatgtgccggatcgccgcttcgatttcccccggttcaatccggtagccgcggactttcacctgtccgtctgaacgaccgagccattcgacaaggccgtcttctgtccagcgtgcgatatcgcccgtctgatacatgcgttctcccggataaaacggatcaacgacaaagcgctcctccgtcagctcagggcggttcagatagcccgggccacgccggtccccgcgatgtacagctctcctgccacgcccgcaggctggatggttcctccgctatctaatacatacagacgggcacccggaacgggttttccgatcggaagccttgtccgtccgctgtcccgttttcggtcacagacgtaaaacgccgcatcaaccgtcgcttccgtcggtccatagccgtgaataagcatggtctccggcagaagatcggcaaaccgggcagccgtaagcggggaaagagcttcccctccggcgaacacgcgtgtcagtgttctgccgaggcgtgttcttgtttccgcaggctctgtttccagcgcgtctaaaaagctgttgaccatcgccggaataaaatgcgcggtcgtcaccttttctgaggcaaacgcttcaatcatccgcacaggatctttctcccagccggccggaagcagatacacggaggcgccggacatcgtccaccaaaacaattgccagatggaggcgtcgaatgaaaaggatgatttcagcacgataatatcctcttccgttaacggaaactgcccttgcatccctgataaaaaggcggcggcttgacggtgttcaacagccactcccttcggtgttcccgtcgaaccggacgtataaatgatataagcgagcgaatcagcatccgcttcttcagagacagcccctgtctccgtctcatttgtcagagaagaaagagacacttctagcgtttcaccggaaaaaccggaaacggataaccccggctgtgcaagcaggagacaagcgccgctgtcctcaagcatatatcgcagcctgtcctcaggatactccgggtcaagcggcacgtaggcgccgcccgcttttaacacggcaagcactgaaaccgccatctccggcgagcgttcagcgagtacgccgaccatgctttctttgcggatgcctttttggcggagccgaacggcgagcctgtctgtgtactggtcaagctcagcgtacgtcagcataccgcccggaaaacggagcgccggacgatgcggcgaaagcgcggcgcggcgggcaaacagcccgtgaagcgtcggggccggcggttcagccgtttctgtatggttaaacgcagttaacacccgtttcttttctttttcatccgccatatcaatatgccgaatcagccggtttggatttctaacggcattttcaacgatcgtcagcaaatgagtttgaattcgtttaatcgatgttttagtaaataaagcggattgataatcaaaattcagctcaatcaatcccgtatctgtccgctccttaattaaaatggacagctcatttgccgtatgcccgctgaaaaacatcgccgtttcataatcgaaaccttctgcctgacgccacgcgagaggctggtattgcatcgaaatcccgatgatattttgcaggtcgtgatgaatctgccttaattcattgacaaaaagattgtaaggatatttctggtgccgcataacagacagctgctgttttcctacactgcggacaaaagacacgaactccgcatccggatctgccgtcattctgatcggtagcgtgctgacgaacatgccgagcatatccttttcgagcttggaaccgcggtttccgtaataagtaccgatggcaatatcctttttagccgtcagacggctgatgcatatgtataacgaagccataaacagagagatgatgctgacattatgatctttgcaaaaacgccggattgattgttctaaggagtgggaaagagtgattgtatctcttgaagctgcagtgctttgtctaagatgagaggttcgttccgccagtgaaaggtgttccggaacggttcggtatgtttcagtccaaaatgaacggtctttttgaaaacgggaagactgtaggtattgctgttctttttccatgtagctgagataggaagggctttggtgttcggccaaatcctcgcttcgcatgattttttggtagatttcaatgagctgattgccaagcagattgagcgagatgccgtccataataatatggtgaaattttgaataaagccaaacttcttcgtctgacatgacaagcagagtaaaatgatacagcggtgaatgaaacagcttgaacggaacacgcgtctgtttgtcaatccatgcatcccgctctgattgatcaatatgagtaaaatcaacggtctctaaagaaatcggccgatgcccggccagatacagctggggttctgagccgtccccttccgtcagttgaaacctgagcgaatcattttgcaagatagagaaatctaaagcacggcgcaatacgtcaaagtcgatattccccctgaatttgacgcacgccgcaagattgcagatacttgtgcccggctcgagcagctctgtaaaccagactcttctttgggcgtgagttaaagaataaacagtgttcttcaatggaatccctccatttcaatttaagaggataagaaagtgaaataattacaattaaatttcgacagcatatgactaaatcatccatataagcattattttaaaacatattttagaaatcacaataaaaaattaaattttttctaacattttttagaatatagtatatattcctcacttcacttcttcatttctataatttttataccatgtaaaacagtatgtatgtacactgcaaactggttctaaaacactataataaggaataaaatgtataattaattgcgcttttaaaaaggttttgctttccgaaaagaaattttatgataaaaaatgaaaaatcagtgaacaagtaagaaagtatcatgtaaaaaaaaggaagaatgttgccgatattactttttgaaaagattgattcataatcgcaatataatgttttacagacatcaaaaaagccgaaccctctaaggatccggcccttcttattgatttgccagcacgactgcgattttgtcttcaatgtcttttccgtcatcttcgtcaagcagcccgttttgaagcacggaaaaaataagcgtatctcctgtttttgtgtctgcatagccggcaatcgaactgactgatgttagtgacccggtttttgctttaattttgccctctgccggagtattcttcagccggttccgaagagtgcctcccgtcattctgtcgcttgcaccggcgacagggagcgaacgaaggaaagccgggtaccacttctctttctgaaccgcatacaaaagctctccgatttggccggcggatacgccgttaatatgagaaacgccggatccgtctcttgcaatcaattcatccggattgagcccgaacgatttgagctccgatttcatcacgtccaagcccttttcccagctgccctccccttttttcacttttcccatttccttgatcagaatttcggcgtgcccgttgttgctcagtttcataaacgggatcaataattctgaaagaggcatggatgtccgtgatgtgacaagctgggtgcggtgcggcattcggcctgttctgattttcccttttacagttacaccctgtttagtaagcgcttgtttccataaatctaaagcataggacgacggatcccacactgccgcccattctcttgcctttgccgagccggcaggtatggctccctttatcgtaatcacattgccaccgtgctcccgttcaaccgtcaattctttcttttcatcagaagcgacggtttttacttcatttttcacacgaacgatgtccgtatagggagaaattgaaatgcgcggctttttatcgggctgtttcgccgggctgatttccgcaatcaccgttccggtatcataatcctcatttggggaagcggtaagagctgatacttgcgcgccataatattggccttcatcactccacggaagatcaactgaatacctggtatcgtcataccacgaatcatccccgaccagatctcctttaatgacatggatgcctctggctttgacctgtttagccatcttctcaaaatcagaagccaatagggtcggatcgccttttcccctgagataaaggtttccgcgcagctgttttcctttcacggcgccgtctgcccgtacttctgtcttaaaggtgtaatcttctccgagaacggaaagcgccgcagatgccgtcagcagtttcatcaatgatgcaggcctcagccgcatatcttcccggctgccgaacagcacctcccctgtttttgctgaccggacaatgatgcccgctgaagccccctttaaagcgggttcttcatccagaatgtgttccagctctttttgcaaagtatttttttgttcagccgccttagccgcatcatcaatataaggaacttcggcaatgatcaaaagcagaatcaccgcgcacaagcgtttcacatatgttttcaatgttatcccgcctctttcctattcttcgtcatgcaaaatggtgatcccggatgacgcagccgcttcttcgcccggtttcagaatctgaagccctgtcagtgatgcaggctgattcagattaaatgcatctgtaacggaagtataaggctcaagactgacaaacccctgctttccgtcaccgttatataccacccaatgcttgaaagacgtgtctgcctgatacaaaacggataatttctcattcggatgataaataacagcttcgttattgccgccattccgtccggaagaaagaaaaacatcgtcaaactgtttatttttcaaagacatcccatgacggaacgcttctttatcaggaacatccaataaacggcccgtcggtacgaaacgttcatttaattcccacatgcggtcagccgtcaaaaatagacgggattgctcttcattgaaaacaaatgtggaatgatagcctagcccccaaggaaaagcctccgttcccttattcataatcagcgcccgctgcgtaaacacattgtcttttaatgtataggtcatccggacaatgacatcgtgcggaaattgtttatgaacacggggaatctttgaaagatcaatttctgtttcgactgtcattccatccccctcttctttcgctgctgccgctttccaatgctgattgtgaagaaagccgtgaatatgattatgtttatcctcttcgtttatctcgaattgatacgagcggccgtcaaaacgaaacgtcccgtccgtaatccggttcggcgggaataaaacgggaatgccgtacagcatcggttttttgaggaattcctccgcagtttccggttctctcagaagccgcataccggttcttttatcccgaagcgatatgacatttgatccccactccggcacaatgatgcattcagcctgatcagtctccgcctttatggctgaaactcctaaataagtcgtatgttcaatcgtcataagcacctgccctttccttgttttctagcatgtataggaattccattttctaaactcattttccttctctaaaaaaaacatcgcccgtatgaactgagcgatgtgcggtaaaaccttattgaatcagccgggtaatctgttttttcttccatacaaaccggtaatatccgtattgcagcagcaggctgacgacaaaagccgccggataaccgacccaaatgccgagaatgccgagattcgtataatgagaaagaataaaggccacaggcacttcaattccccaaatcgtaaaaatgctgataatcgtcggccataacaccgtaccgctcgcccgcattgttgctgaaacaatctgagcgtgaccgaaaatcagatagctccaaagggtaatcataatcagattgcgggcaatgcggagtgtatcctgatcggttaaaaacaaagccagtatctgccgggagaaggtgtaaatcagcacaatcaaaaccccgccgatcaaataattcaggccgatgccgactttgatgacctgcttcagccggccgaattgattggcgccaatggattgggcggcaaaaattgaaacggcgataccgaggcttaccgccggcatctgcacataactcgccacttggttgacgaccccgtaagcagccgtcgcgtttgatccgtaatgattgacaaatgaaatgaccgcaatttcagaaagtgatacgagaatcatattgatgcttgacggaataccgagacggagtaaaagcgcgagcagctttttgtccattttaagagaacggagcgcagtccggtcaaatgccaatggatgtttccttttccgcaaataaaccatgagtacgataaatgtcacgatgtttgaaatcacggttgcatacgccgaaccgtaaatgccgaacttcggaagtccgaaaagcccgagaatcaataagggcaagagaccgatgtttatgactgtactgacgattaacgtataaaacggagtctttgaatctcccgttccgcgtaaaaatgtcgtatacgcaaaatataaaaacatcagcggcattgcgcaaaacaaaatacgcgcatatcggacactgacatctattacgttttccggcgttcccatcagccgcagaatatcaagcgtaaacacactgccgacaactgccagaacaacaccgagcataaaggtaaaagtcagtgtagtgccgacaatcgccttcatcctctcttcgtttttcgcgccgtaagcctgcccgatcagaatggaacttcccgaaccgattccgatcgtaaaggagatcagcagaaaaaacagcggaaaaaaagacgatacggcggcaagcgcatcaactccgagccaccttccgacaaataccattccgaccaattggccgacagattgcaatacattgcttaaaagcagcggcactaaaaacagtgacatcgatcgccagacagactggccgcggccttccgctgtttctaaatgatcttgtacttccatatgtaggactccttttttgattttcttccattttattattcagcagacagcttgtaaaaaccttttgttcaatgaaactctttatcttattctcacgtcttacatggaaataaaccataaaaataaaaagtccggaaaatatttctgaaaaggtattgtaatcttatcgtaattattgtaacatttgtaacataagagaaagagattgattgaaggagagattatatcatgaaaaaatggctattattcctcactactattacattgattctgtcattgggcactgcggcgaccgcaaaaaatgcacctaatgaccttacacaaaaacaagcacttcagctggccctgtcagcgagagaacatttctggaacacgatgagcggcggtgcgcttaaatcaaacgcaaactgcacatctgaaccgtttgaatatcaaaatcttcaatacgtctttatgtgcaaagacctcggaacaaaagcgaaagccgtaaaatatctgacacccgcttttacaaagcaagcgattgacaaagggctcaaagattaccacttcactgtaaaagacggcaaattggctgttccgctcggcgacggagataacctcctgaattggaaaaaagcaaaaatgactcttctttctaaaaaaggaagcgttcaaacataccgcttcactgtaccgactcttgacggttcaccgtcagcaaaacgcgatgtaacattcgtaaaagaaaacaacgtttggaaagtcaatcaatttgatgctgtcatataagaaaaagcccgcttgcttacagcgggcttttttcacatcatttccaccaggttcttgcaaaatattaaactcaaaaaccccttgtataacaaggggttttctgtcttgccgacattattaatccgcacctatcttatgtcgaaaacgctctaggagagattcgaactcccgacctgcagtttaggaaactgctgcactatccgctgtgctactagagcctgcttctattatagtaacgctggcggccgtttttttcaagcctacagccctccgaacactttataggcggctctcgtcgtatcttcatctattccgatataacgcattgtaatagacggagaagaatgattcaaaatcctctgcagttcagcaatgtcttttgtcctctgataaaaatgatacccgaacgtctttctaagcgtatgcgtcccgatttcctccaatccgcacgcggcagctgcttcctttaatattctgtatgcctgaatccgggaaatgggcttattcgtccgtttcgatttaaacaaatagtcatcctctttcatgtcttttgtataagcgtatatgtcggccttcaaagactccagtatcagaatttttcttttctttctcgttttgctttcggttgcccacacatggtctttgttccttacatccctcacgcgaagcggcagaacatcagaaatccgcagtgcgctgttcatgccgaaaataaataaaaaataatcacgatcacttttcttcattaaatactgtttgacttcctggatcttctccaaacttcggatcggctgtacgatatgcatcaaaaaaccccttataattggtaaagtaacatattgagcattatgttactattatagccgaaacctgttgaatgataaaggataaagggccttatgtaacataatatacatagtgttacataaggggaataaggcacgcagtttcatcgaagtcttcaaaacatcattttcgacccgatgacgggattttaaatcaacagagactcacggtattaaaaaagaaaaacaacgcccttaaaacgaaatctgagcattcgtttttttgtgagcaaccgaaaaaaatgaaaaaaaaagacacaatatgaaattgtgtcctagtcttcatcttttacatcaatgtcttcaggaagcggctcatttaaaaactcttgaatcatttccttatatttttccagctgttcgagatgggtttgaaattgttccttgttgattaaatattgctgtccgtcatgtacggcccttattttattcgtcaaaacaagattgtgcacatattcttcaggaagactggtaaactcagctgtctctttgatcgttaaatacatggctcacgttcctttcatatgtcatgtgagtgaattctgttttgtttattgtagcttattttttgtctttatgcttgtttcacagctttttctgcccggtttcccatttagcctatttgcgactgattacattcacacagaaactccggctttttgcgcaccggactattccgtttgtcacttgtgaaaacagcacattttacttactctataattgtaagcggaaaacaaaggaggcagactatgaaaaagaaaaagtttatgaatctctgttttatcgttctgctcagtactttgctcacggccggaagcatcccttatcacgctcaggctaagaaacacccgttttcctatgacgactacaaacaggtagatgtcggcaaagacggcatggttgccaccgcccatcctctcgcttcacaaatcggtgccgacgtgctgaaaaaaggaggcaatgcaattgacgccgcggtcgccattcaattcgcattaaacgtaactgaacctatgatgtcgggaatcggcggcggcggatttatgatggtttatgatgcgaagacgaaagacaccaccattatcgacagccgggaacgcgcaccggcaggcgcagcaccggatatgttccttgacgaaaacggcaaagccatccctttctccgaacgcgttactaaagggactgcagtcggtgttccgggaacattaaaaggacttgaaaaagcgctcgacaaatggggcacacgctccatgaaacaactcatcaccccttccattaaacttgcctcaaaaggctttccgatcgattcggttttagctgatgccatctcagattataaaaacaaattatcacacaccgctgcaaaagacgtgtttcttccggacggagaacctctgaaagaaggagacacactcatccaaaaagacttagccaaaacatttacagctattaagtacaaaggcacaaaagcattctatgacggtgcattctccaaaaagcttgcggaaacagtgcaggaattcggcggctcaatgacagaaaaagatatcaaaaacttcaatgtgacgattgacgaaccgatctggggggattaccagggctatcatatcgcaactgctcctcctccaagctcgggcggtgttttcctgttgcaaatgctgaaccttctggatgattttaagctttctcaatatgatatccgttcttggcaaaaatatcagcttctcgcagaaacgatgcatttggcttatgctgaccgcgccgcatttgccggggatccagaattcgtcaacgtccctctcaaaggcctcttgaatccagattatatcaatgcccgcagacagctgatagatattgataaagtcaataaaaaaccgaaagccggcgacccttgggcctatcaggaaggttctgcaaactataaacaagtgaagcagccgactgacaaacaagaaggccaaacgacccacttcacggtaaccgaccgcttcggcaatgtcgtatcttatacgacaacgattgaacagctgttcggttccggcattatggttcccggatacggcgttgtgttgaataatgagttaacagacttcgatgcggtgcctggcggcgcaaatgaagtgcagccgaataaacgtccgctcagcagcatgactccgactattttattcaaaaataacgaacctgtcctgactgtcggctctcccggcggagcaacgattatttcttccgtcctgcaaacgatcctgaacaaagtcgagtacggcatggatctgaaagcggcggtcgaagagccgagaatttacacaaacagcatgacatcctatagatatgaaaaaggagtgccggaagaagcccgcacaaaactgaacgaaatggggcataaattcggcagcagcccggttgatatcggtaatgtgcaaagcatcctgatcgatcgtgaaaacggcacctttaccggagttgccgactcaagccgaaacggagccgcaatcggcgtaaacttgaaacaatataaaaaataactaggcaaaaagcctcgtttctcaagctgagaaatgaggcttttgtttattctgcactgtattcagatgagggtttttcagatgttaacgaggcaagtgaaagcacgccgcacatcgcgatgacaacacccgctgatccgatccatgtcactgacgcaagagacagatgagtgacaacaatgcccccgatgcccgccccggccgccatagccagctgcatcacagactggttgaggccaagtaatacacccgatgattcaggctccatcgttgccaaatgatactgctgagcaggtcctgatgaccaggcggcgaaggaccaaaaaataagcactgccgccgctccgaaagcagaatgtgtgacaaacggcaataacatgagcatgatagcatgaagcgccattccgccggttaatgtcatacgcgcccccatttgtcagcactgaaaccgcctgctttagaaccggcaagactagcaacaccgaaaataagcagcaatgtactcagtattccgctgccgatatgagtgacgttcagtaaatacggagaaaggtacgtatacgcaaccgaatagcctccgagccaaaaaaacgtaatagcaagcccgacagccacctttcgtttcttcaaaagagaaaattgctgaataagcggcaccggtttatctccttttatctcaggcaacgcaaaacgtataataagcatggcaatgattccgattgccgcaattccggcgaaaaccaccttccagccaaaagcttcagacacggttcttccgatcggaacaccgataatgagcgccgccgtaaaccccataatgacggtcgcgagagaacttgcctgttttcccgggggagcgatttttgctgcgatcgtaagcgcggtgaccaccacagttcctgctccaagcgccatgatcacccgggctgccgcaaataagccgtatccctgtacaagaaatgaaatgatatttccgattacaaacaatccaagagcatagatcatgagcttccttctgtccagttttgctgtaagggccatcatgacaggcgttccgattgcataaacaagtgaaaaaatcgtaatcagctgccctgctgctgccacagtaactcccaaggaacctgcaattttatcaagcatcccggatatcacatattcagacgtccccactaaaaagctgataattgccaaaatgtaaatcttccaggtattttgcacctgacacactccttcattgataatttatataaagatatattgtgatatatcgatataaagaattgaacaaacagaaacaaatcgcaatatgtcgatgtgtagtcgaaaaaagaaactgaatccctcttctaaaggattcagccctacatttcgcgctgaaaataatcggccatcgcctttatcgcatcttcatctcttttataataggtgtatttgccaatccgttttgtttggataaggcctgcgcgctgaagaatggaaagatattgagacgccgttgactgtgtcatctgaagcttatcggtgatctggctgacacatactccgatctcattcatatcaatgccatcatgcggtgcgaagtgacggtccggctctttcagccattgtaaaatctcaagccgtgactcattagacaacgctttaaaaacatcaataggtttcatacgctttattatatcgtgattttgcgatatgtcaatgttatttttcttgaatctctattttttgttttgtctctcttatgatccgggaaataaaatcactcacattctcttcaaatgtgttttcccgcccgtattgccttacatgtacagaatggtggcggcactcttgatctcccacaaccgccatatacggtatttttttcatttgtgcttctctgattttatagccgagtttttcatcacgctgatcgagctcagcccggatacccgctttctttttgagaaaaaccggaacgaaaaaaaattggcgtacacagctgtcctgttttctcatcttctgttcgataatgtttttaatccattcagcagttcttcaaacgccgatgttaaaaataaatcactccggtagatgaatgatatattcatattccgaaaatgttcaggaagctcatgaagaaaaagatttttcctgttttgaaaataacggacggctgatgcaggcagaaaggagacccccatccccgcctgcaccgccccaataatggcttccaacgtaccgaattcaatgattttatgtgcgggcactgcctcttctttcagtatgttttttattttgcggcggtgcgaacagcccgcggcaaaatacagaatcggctctcgcagcaagtcttgcaaactgccttcccgcttatttgaaaccaagaccaattcttcttgaaatacagcgacttgctcaagatcttcatattcgaccggtccgtaaacaaaagcgccgtccagctcatagtgtagaacgcgctgcactaaggtatgtgtatcaccggttgacagagacagctgtactttcgggtagcggctgcaatactccgtgaaaaattgagggagatggacggctgccgccgtttcaagagaaccgattcgaagcgggccgttcggatcgcctgcctctcgcgctgttttttgcgcctcatgcagcaattgaaggattctgtctgcgtcttttaataagttttcacctgttggcgtcagcgtcattccccgatttgtgcggtaaaaaagctgtgtttgcaattgccgttccagctgctgaatccggtttgtcacatttgattgaacataatgcaggctttctgccgcctttgaaatacttcctttgcgggcgacagcctgaaaaatctttaagtctccgctttccatctaagggcaccttcttgctatgatttttattgatagccggctatcaattttcatttatttactgcagctgatacagcctgtaaaatttttctcatcaatcataaaggagagaagaatcatgaatgtccttatcatacacgaaaatggctttaatttcaggcaggcacctgacaaaaggccgggaaacggcgaagtaaaaataaagctgaaaacagccggattaaaccatcgtgatttgtttttaatgaaaaaacacgaaaccggaaaccatgaatttattctcggttcagacggcgcgggaatcgtaaccgaaataggacacggcgtccggtctcatttactgaatgcagaagtcatcatcaacccggtactgaattggaagactgttgaggacgtaccagccgtccctgatattttaggcggtccgagcgacggaacattttcaccttatgtcatcgttcctgcggaaaatgccgttttaaaacccgaacacctgacttgggaggaagcgggcgtcctgccgttatcagcattaaccgcttatcgcgccttatttacaaaaggacaattaaaaaaaggcgaacaccttatccttccgggcatcggaagcggcgtggcaacatatgccttattaatggcaaaagctatcggagcgacagtcagcgtcacctcccgcagtgaaaacaaaaaacaaaccgcactgtcatacggtgcagaccgggcgattgacagctacggtgactggaatgaggcgctgaatggcgaaaaagcagatatcatacttgacggtgtaggccccgctttatatcaacactatcttgacattattaaaccgaatggccggatcgtaacattcggcgccagttcaggcgatcagctcggatttcccattcgctcgctgttttttccgcagattcatattctcggtacatcaatgggaagcaatgaggaattcgcggatatgctggaattgataaaccgctgcgagctccgtcccattatcgaccgcatgtaccctctcagtgaagcagctcccgcttttaacagaatgcgggaaggacggcagttcggcaatatcggctttcgtatagatgtctaaaaaaaggaacggacccgtccgttcccttatttgtttttaagcgtttccgcttgaaattcaatatgtttttcttcatcgattaaaatctgcccgcaaatcgactgcagacacacagagcccgtcatgttttttaaggcgtcattttaaacggcagcgatgacttccgccgtcagcagcaccctgatcgattgcgcaaggcttgcaaatcgtatcagtctgcggaaaaaaacaatctctccgctctgtaaaacaaaattccatatttatcctccatttccacattacctttatatgaccaatacaagaagaaggaggttccatttcaatacgaaaaaccggctgatcccagccggttttataaataaacccctttatttacggtaaaacagtgctccccattaaataactgtcgacttcgcgcgctgcttcccggccttcattaatcgcccatacaatcaggctttggccccttctcgcatcccctgcggcgaaaacaccgtcaacattcgttttataatccccatatgccgcctgaattttatgatttgccgaatcgactccgaactgtttcaataatggctgttctgtcccttcaaaaccgatggcgatgaacaccagctgagcaggccagactttttctgtaccgggcagttcatgaaattcatactttccgaattcgtttctgactttttccatttgaatggtgtggatctcttgtaagcggccctgcttatcggccaccatttttgtcgtttgaattgaatattctctcgggtctttgccgaactttgcctgcgcttcttcataggcgtattcaagggtaaagacgtgcggctgttcaggccacatattgtcgttcgtgcgcgtctgaggaagtttaggatgtttcccgaactggtgcacgctgcgcgctttttgacgcagcgcggttgccacgcagtcagctcctgtgtctcctccgccgatcacgatgacatctttccctttagcgtctataaattgtttgtctttgaagttggaatctaaatagcttttcgtcgccagtgttaaatagtccatcgcataatggacgccttttgcttcccggccttcaatcagcagattgcgctgcttttgggcgcctgtgcacaaaatgacggcatcaaattgttctttcagctcatctgccgttatatcaacgccgatttcggtatttgtcacaaaatctataccttcctgcgtcaaaagcttaatacggcgttcgacgacatttttctcaagcttcatgctcggaatgccgtacatcagcaggccgccggctctgtcggcacgctcgtagaccgttacggaatgaccggcttgattcagctgatcagcgcttgccagacctgccgggcctgaaccgacgacagcgacttttttacctgtgcgtttcgcgggaattctcggctgaatccatccattttcaaaacctttgtcaatgatcgtccgctcgatgtttttaattgaaacagccggatctgaaatggccagcgtacaagatccttcacaaggagcgggacagacccgccctgtgaattcaggaaagttattcgttttcagaaggcgctccaaggcttctttccagcgcccccgatagacgaggtcattccactccggtatcagattataaatcgggcatccggaggtaaaaccgttgatatcagcgccgatttggcaaaacggtgtgccgcaatccatacaccgcgccccctgccgctttgacgcttcatctgaaaatggagccgaatactctttccaatcctttaagcgagtgagagggtcccgctcagccggtttttctcgtttttcttccatgaatccagttggtttccccatgttcctctcccctttcttactgtactaccgcttgtttttgatctttggcaggcgtttgctgaacctttgtattggcttcaaaagcatacataattgcgtcttcttctgataaacccgccgctttttgttcttcgatgctgaggagcatttgtttatagtttttcggaatgactttgataaaggtttctgcggctttttcccaattgtccaggagatttgcggcttttttgctgtttgtcagcgccgcatgccgtttgaccatttcttgcacttctttgatctccgcctcatccgtcagcttttcaaatgaaatcatttccatgttgcatttgcgtttaaatgctttggcatcttcactcaggacgtatgcgataccgcctgacattcccgccccgaagtttttgccgacttcgccgaggacgacaacccggccgcctgtcatgtattcgcagccgtggtctccgataccttctacaacgacattgactccgctgttacggactgcaaaacgttcaccggcgcgcccgttaatgtacgcttccccgcttgttgctccgtaaaatgcgacgttcccgataataacgttatcgtgtgtttcataattgaaggcatcaggcgctttcacgatgatttttccgcctgaaagccctttgcctacgtagtcatttgaatccccgttcaaatgaagcgtcatccctttagggacaaatgcaccgaaactctgtccggctgatccggtaaaatgaagtctgatcgtatcatccggcaggccttccgctccgtagcgtttagaaatttcacttcccgtcacggttccggctacgcggtttgtattattgatcttgatttcagcttccgcttcctgaccggcttcaattgcagcctgcaccgccggaagaataaccgtcatatcaagcgactcgtcgattttatggttttgcgccgtacggaaagtgcgtatgccttcaggctggtacagcagtgtggataaatcaagctggcccgctttccaatgcgctttcgcacgttcactgacatgaagaacgtctgtccgtccgatcatttcatcaagcgtcttaaagcctaactgcgccatatattcacgcacttcttctgcgacaaacagcatgtaatttacgatatggtcaggattgcccatgaattttttgcggagctccggattttgcgtcgcgacacctacaggacatgtatctaaatggcaggcgcgcatcatgatgcagccaagaacgacaagcggcgctgtagcaaagccgaattcctccgcaccgagcaaggcggccatcacgacatctcggcctgtcatcagcttaccgtccgtttccaataccacgcgatcccgtaaaccgttcagcatcagcgtttggtgagcttctgcaagaccaagctcccacggaagaccggtatgtttaatactcgttttcggcgatgcgcccgttccgccatcgtagccgctgatgacgatgacatccgcagtgccttttgccacaccggccgcaatcgtgccgacaccggcttttgacacgagcttgacgctgattcgcgcgcttcgatttgcatttttcaaatcatggatcagctgcgccaaatcttcaattgaataaatatcatggtgaggaggcggtgagatcagccctacacctggtgtagaaccgcggacatccgcgacccaaggatatactttgttccccggaagctgaccgccttctcccggcttcgctccttgcgccattttgatctgcaattcatccgcattgacgagataatggctctttacgccgaaacggccggaggcgatctgtttaatcgcacttcttctgtcgtcgccattttcatccggaacgaaacgtttcgggtcctcgccgccttctccgctgttgctttttccgccaagcctgttcatcgctatcgctaaagcctcatgggcttccttgcttaatgaaccgaatgacatcgctcctgttttaaaacgtttcacgatggacgcagctgattcaacttcctctaattttaaaggcttgcggtcttctttgaaggcgaacagattgcgtaaaaatccgattcgttcttcatccgctgcatgagaatactgcttaaacaagctgtaatcattttttcggcaggcccattgcagcgtatggatggttttcgggttgaaagcgtggtgctctcccccgttccgccattggaattcacttccaggatcaagagtttggctgtaatcatccttgtacgccgcttgatggcgctgtttcgcttcttgcgcaatcgtctcgatatcgattccgccaagctgagatgcagtaccggtaaagtatttggcgataacgtcttcaccgatgccgaccgcttcaaaaatttgggcgcccctgtaactttgcacagttgaaatccccatttttgacatcactttcacgacgccttctgttacgctctttccgtatttgctgacagcttcttcatacggaatatcaagccggccttcatcgatttcctgcttatacgtagcataagtcaaatacggattgacagcatcggcaccatacccgatgagagccgcaaagtgatgaacttcacgcgcttccccggattcaacgataatgcttgcttttgttcgcaggccttgacggatcaaatgctgatgcagcgcactgacggccaaaagcggcggaatcggcgtcaattccttactcattgccctgtcagataaaattaacagagatacgccttccttgatcgctttttccgcttgctgaaacaaatccttcaggcctttttccaggtcatcggaaaacagcgtgcggatgttctggctcttaatatcagggtgcacaagtgttttcagcgcataaaactgttcgtttgataatacaggagtatacaattttatgcggcgtgcatttctttcactcggatgcagcagatcaccttcagccccaagccatgtcaccgtagaggtcacaagctgctcgcggatcgcgtcaatcggcgggtttgtgacttgcgcaaacagctgtttaaagtaatgaaacagtgattgggcgcgatcggataaaacggcgagcggcgaatcatttcccatagagccgagcgggtccttgccttctttaataacaggaattaaatatttctggatatcttcatacgtatagccaaacgctttttgacggacgagaagatcatcgaattgttcctcttcccggatttccgggtcaggattcacttgaaccaattcttcttcaagccatttttgatacgggaattcattggcgatttctgtttttacttcttcatctgaaataatccggccttcctctaagtcaatgagcagcatttttccgggctccagacgttttttatgaagaatgttcttctgctccacttcaataacgccgacctcagatgagaaaataatatggtcatcttttgtcacatagtaacgtgccggacgcaggccgttacggtcaaggatggcgccgatttgttttccgtccgtaaacgaaatggcggtcggcccgtcccacggctccattaaagagctgtgatattcataaaaagcccgtttcgctttagacatgtgagtgttttccgtccatggttccggaatcagcatcattgccgtatgtgccggtttccgccccgccatcacgaaaaattcaaacgcattatcaagaatggatgagtcactgccctcagcatttaaaatcggcagcactttgtgaagatcgtctccgaagctttctgaaacgaactgctgctccctcgctctcatccaattgatgttgccccggagcgtattgatttctccgttatgaatcagatagcggttcggatgggcacgttcccaagtaggaaaggtatttgtgctgaatcttgaatgcacgagtgaaaatgcagatacgaaggtttcatcctgcaaatccaaataaaaagcgtcaacctgctcaggcgttaacaaccctttataaacaatagtctggcttgacaggcttgcgaagtaaaaatcaagctgttcttgaacgccccaattttcagcctgcttccggataacatacaatttgcgttcaaaagcaaggctgtctttcaaatcgtttgcggctccgataaatacttgacgcacatacgggcaagtgctttgtgccactgttccgatttttccgacatttacagggacggttctccagccgagaacgatctgtccttcctgctcaatgaatgcattcacctgtttttcgatcttttttctttcctcttcattttgcgagaaaaagaccattcctaccccgtaacggcctttttccggcagcttcatttctccgcactctttcttaaaaaaagcatcagggatctgaaccatcaggccggcgccgtcacccgtattcggatcactgccctgtcctcctctgtgatccagctggcaaagcatcttcagtccttttttgacaatgtcatgtgaaggtttcccttttaaatgggcatacaagccgattccgcatgcatcgtgctcaaattccggacggtagagaccttgtgctttcggcatttgattgtaagtcataattcctctcccccgatcagtttccgttaattatcggtcataaaatctgacaactttaaattaattgtaagttttcaaaacaatataaacaatatataatttagatcaaatacatctcaaaatgagatagatgggtgtgaacgcaatggaattacgccagcttcggtattttatggaggtagcagaacgggaacatgtgtcagaagcggctgatcatctgcatgtcgcacaatccgccatcagccggcagattgcaaatcttgaagaagagctgaaagtcactttatttgaacgggaaggcagaaatattaaattaacgccgatcggcaaacaatttttagaacatgttaaaacggcgatgaaagcaattgattatgcgaaggaacaaattgatgaatatcttgatccgaatcgcggaaccgtcaaaataggatttccgacgagccttgcaagccagcttttgccgactgtgatttcggcatttaaagaggaatacccgaacgttgagtttttgctccgccagggttcttataagtttttaatcgaagcggtaagaaacagggatatagatgctgcgctgctcggccccgttccgacggaattccccgacataacaggcaatatcttattcacggaaaagatttacgcgcttgttccgctgcatcatccgcttgccaaacagaaaaatattcatttaattgatctgcgcggggaccaattcgttttatttcctgaagggtttattctccgaaacatggcgattgacgcttgcagacaggccggctttgcgccgcttgtatcgacggaaggcgaggatttagatgccattaaaggattagtctccgcggggatgggagttactttattgcctgaaagcacctttgcagaaaccacaccccggttcacggtcaaaattccgattgaatttcctcaagtgaagcggaccgtaggcattattaaaccaaaaggaagagaactggctccgtctgcaaatgatttctatcattttgtcattcaatttttctccaaacttgaacaatatcaataaaaaacaaacccgagcttcaaaacgaagcctcgggctttttcatatttttatagatctttctcagccgatcggaatggatagttcaacgtggcagacaaacgcttccggatcaatgactgattgatcggtctgtttgtgaggcgtttctttaaatgtcttcagctgggctgaggaatagttgacgatgccgagtccgagctcttctccctgctgatcaagcagcctgacaaccgctccgctgctgaatctgcccttaatctgttcgatatcctgcggtgacagcgccatatttccgtttgcgacatcgcggctgcttttcttttccatcacaatttcgccttcggggccggaattaaatgcaagccattgttctttgtggtttaacggcagggttccttccgcttcaaaataagttccttcagccgcctcatctaccgcttgaagcagaatgtccggaatgttagcctgcccgagaaagcctttaataccggaggccatcacaatcttaaaagcatccagtttcgaacgcattccgccggttcccatttcactcccggcatctcccgcgcttgcttctatttccggagtgatgtcacttacatgtctgattcttttcgctttcgggttgctgcgcggattatcatcatataaaccgtcaatgtctgataaaattacaagcatgtcggcatcaattaaacctgccaccttcgctgcaagtgtatcgttatctccgaatttcagccggttgactgtgaccgtgtcattttcattaataatcggaataatgccccgttccaaaaggacgttcatcgtattgcgcacattatggtagcggtattcatcggaaaaatcgcttcttgtaattaatatttgtgatgcgacataaccgtgcgctaaaaacagctttgagtaagcctccattaataatccctgcccgatggaagcagaagcctgtttttcagggaggccttccggtttctgaataaatccgagcttccgataacctgccgccactgcgccggaagatattaaaatcacttcatagccgctgtccttcagctgtgcgatttgatccaccaatgcttccagctttcttctgctgatttccccgtgcaggctcgtcagtgagctgcttccgattttcaccgcgactcttttgatcttcgtccgagacgtcactgtatcactcctgttttttaacgattatagtgctgccgttttttcaattgttttgctgatctcaatagaacgttcggtcgcgtgtttaatggctttggcaatggcttctccgccgccttctgacctgagcgcatcgaggccggcttccgtcgtgccgtttggagaggtgatgttttcccgaagcacatccggtttttcacccgtttccatcagcatttttgcagcgcccaataacgtttgcgccccgattttgcgggacagccgtttgtctaagccggcttcttcacctgctttttcaataaactccattaaataataaaagtacgccggtccgctgcctgcgatgccggtgaaaatgtccatctgatcttccttgatcacgtacacttccccgaggcattccaaaagagataccgcggtttttgctgaaccgtaagagacatggtctccgaaagccgcagctgttgccgattcgccgatcatgctggatgtgttcggcatcactcttacaactggctgacggtcatgtaatgattgttgtataaatgaggttgttatgcctgccagaacagacaggatgatttgatgaggttgaatacgccgtttcagcgtagcaagagcgatttcagcatccttcggtttcatggctaaaataaagacatcaatgtcttcggttttcatgctgtcaaaagcaatgccttgaattccgtattgatgttccaattcagcgagtcgctctgtattgcggcggtttgtcacgcagatgttttggttgggaattttttttgcgcggaccatgcctgatatcattccttcagccattgatcctgctccgataaaagcaactttcttttgatctaagatcggtaacatctcccttgttcgtattttgttcgtatttttcacacgttttttatgttaccacttcaggagtcgatgtcaagtttggaggttttattgatatgtattgttccgagcctgttattatgtataatgaatcacagaacaaaccttttgagcccgggaggccgggagcgttccggccggatttaaaaattatctgaaatggctttttctatcagctttttgcagcggtcaagctctgtcttcagctgttttttgtaaagctttgcagcttcatagtctttaaattgatagagaacgacttcctggagtttggctccctcttttttcacttttacttgctttaaaatcccgtcatccaaaagttcgtgaagtgaacggtacacctcggtatgattcggcttaaaaccgatgggtttaaattccgaacgcagcacctcgagaagcttcagtccgtaaagccgttcctgctctgtcattgtaatcatgtaaagctttaaaaaggctctttgttttactaaaaaaccggttgaacttcttttttcttctttcaatatgtgcccacccttccttctaacaaattattccatgtactaaatattctctttatatcccgttttcccttttattgttcggacagtttggtttatattgatttgttttttggatgcggggaaaaataatcttattgaacatttggtacatagtttatttagtttaattatagctgatatcggtttctttttcactcttttttctgcaaaaacggatctttatgcctatttaatcgggttgcgaaaacaaaaaagacccgtcacaaagacaggtccccttttgattaaggattagttgaccacaaaccggcagttttgatgaaaatgcgcgggtgtaatttcaattgagcaaccatatattctgcaagatcctcaggctgcatgactttttccggattgccgtctgtcagatttaattcaatagacatgtcgcttgcaaccgtgctcggagtcattgcgctgacacggatattgtgttttctgacttcctgcatgagagattcggtcagaccgagaacggcaaatttagaagcgctgtacgcacttgtcgccgcggcgcctctttggcccgccgtagaagaaatattaatgatatctcctgattttctctcaatcatttcaggaagaacggcgcgtgtcacgtggtatacacccattacattaacttgaatgatgtcttcccactcttgaggcgtaagatccaaaaatccgccgaatttgctgattccggcattgttaatcaggatgtcaacctcaccgagttcttctttaatagaagagacggcttgttcaacctctttttggttttttacatcggcagcagcgaatgatgcctttacaccaagggctttcacttcttccgcaaccttttcgacatttgcttctgtacggccgattaaaccgatattgactccttctttggctaaagcgatagcggcggcgcggccgattcctctgcccgcacccgtgataagagccgttttgttttgtaagctttccatgtctttcaccctttctgaatgtccttatgtacgatttcacattataagcagaaaaaaaacaattagcaaataaaatgattcagcacgatccgtaaagggtatcaactgaaaaaaaggagtgaaaagcagatgatcatcattttgtatatcagtgctgccgttgcggctgccgctttaatttatgcagccgtatccgccgtgcattttaaaagaaacacagcgcctgatataaagaagattaacgccgtgacagcgtccatgcagacgtccgttgaagaaatcaaaacagaaacccgtttgttatcacaaaagcagaaagaactgcaggaagactttcttactaaaaaaacagccgtgcaaacgacggcagccgaagttaaaggaacgcctcacgtcctgaaaatgctctggaacgccggtaaaagcggtttatgagcctgcatgtcatccgacgtttttgatgacactaagagaaactggcggattcaaggaggcataacatgatttgcgatcgtgagcggcttgcgcattttttgcagcagcttaaagcattatcatcttcgggaggatttacaaaatcggatttgctgacttcggagttccatttagccaaggacggagatctggatatgtattattcgcctcataatgagtatatcaacccacatgctgcggttgtcatctccggaattacacccggtttttttcagatgcagcgggcgtacaaagcagcggcacagcttttaaaaaacggcgaatctcttgaggtgatagcatatgagacaaaaaaagcggccggactttccggttccatgaggcagcacatcatcgaaatgcttaatgaatgcggtctgccggccgcgcttcacgttgaggattcatcccggttttttgattcaaaaagggagctgcttcatacgacatccgttatcaaacaccctgttttttataaacagaaaaactatacgggacaccggccggccatcagcagatcagctcttctcagccgttacgcgctgacatgttttccggatgaaatagaaatgatgaaaaaagacattctgcttatccctctcggaaaagcagcagaatcagcctgccgcacgctgaagaagaaccgcagaatgggccatgcggtcattctggaaggcttcccgcatccgtccggagcaaacggacatcgtttcaaacaatttcacgaaaacaaacaatcgttacgtgaacaaattcagcggtttgccgggtttcttcatcagccgtaaaaaaacgccccgaattttcggggcgctgctgttaagaagcgtattcaggcaatgctttattgtgttttgccgttttctcttcaggtattttgatttgatttgtcaagatcgcacttacgaaatagagcgctgcgaaaatccatacaacgccttgtgcgccgacaagcccgatgaacgcccaggcaagcgcggggccgacaaatgccgacaggcccgcagccagatttaacacagacatagcagcacctttattgctgccggccgccgtcggcacgatagccccgatcggaacgaacccggcgaggagccctccccatataaaaccgacaatgctgacgaacagcaaattcccatgtgatacaacaggagcataatataataaaagagtaaaaatgccgcagcccactcctccgaaccacatgacagtctttttccagccgaaggcatcgccgactgcgccgaagattaagttaaagacgatatttccgagaaaaatcgttccccaaatttgcagccatacatttgtagaaatgccgtgctgcgccatatgcatcgggaggaataccggaaatccgtatgttccgatgctgttaatgattcgaatgatcccccagagagcacgcgcggattttcagcaaggatggtgattcccttcattaattcctgcgccttttcccgcttatctgcctttttcttttcaaagcggtccctatttaaaatcaaagcaaaaaacgcgccgagacatacccagaaaattgaactccacagcgtattcaaatagccgaaggatttgatggcccagcttgaataccaagcaccgaatacaaacatcccgcagcaatatgcaatccagaaccagccgaccgccgtactgagcctgtttttcggcgaccggtaaatcacccatgtcaaaaatgaataggcaaacagcgggtaacccagccctttaataaaatacgtgacatacatcaccggcaaattaagattctcaaatccgtatgcgataaacgcggctgttccgatgacgtaaaacaacagccccataaacatcgtccgctttgcgccgaaggcttcgaggcagactcctgaaaaccacgacgccacagcaagagaaataccgtaaaccgtaaacaaggatgctgattgctgtaccgtcaagccgttttcgactaaaaacgggctgagccagccttgttcaaggccgtcccccatcataaacagcacgacccctaaaaatccccaggcgagctgtttcggaattcctattttattaagcatttttgttcctcctcagcaatctttcatgttgtcatctcatccccaagtcaggctttcaccgccggctgaaaatgagtaaataatttttgggtatgtttccattcttcatataggaagagatccgtctgatccgcttccggctcaattacctttgtgcaggtcgaaagctctgctttcacaccgagagcttcgttgcaaatcatcaccgctcccattgcggatgcctggctgaacccctctctcttatagattttcttttgaagaaggttagcaagaaactgcgtcaaagcatcactttggaaaccgccgccgcacaccttcacataatcttgtgaaaaggaagccgcctctgttaacgcctcatagttccatttgattgaaaaagcgatttccagcagtgcagctttgacaaaatgggctctgcttaagttttgggacagcggagcgtcaaaaataaatccgccttttgccagtgcgtttttctcaggagataaataggagcctaacgcagatatacaggcatgatcatgtttcggcagacttgcgatttcccgttccatgacgctgtaggattcattcggataaaaaatggattttaatttttgataattgagtcctgttacacccggattcgtttcaagaagccattcaccttcttctgtatggcaattcagccatgcattctctaaactttcggttccggtctccgctgttatctttgtaatcggcgtcgtcgtgccggatacaatgacgatatctcccggctttgcatctgcacttttgatggcaagctgtgtgtctcccccgcctgcaatcacaggcactctttcagaaagaccgagcaccgccgctttcttaaacgttaacattccgacaaccgtcccagatcggacgagtgaaggaagaatggcagaaggcacaccgaagatgttgcataatttctctgaccacgcctttttccttacgtcaaacagcagtgtttcagcagcctgtgacggttcatagcttaaaattccgctcagctcaaatgtcacccagtcactgatgcttgtgatgcacttcacttctttccataaagacggctgtctggcttttaatccgacaagtttcatggcggaaaataaagcgctcggaagacgtccggtttgctgatgcacttcttctgcctcaattccgccttcccattcacgccctctgttatcaatgttgggcagaccgagaaatgcctttttatctttattgatcaaaacgattccctgcctctggcttgttgaggtgattccgattaatgtaatatgagggctcttggcaatagcctttcttgccatagcgctgatttgcgtccataacccttccggtgagaaatatcgtccgtccggataaagcggatccgtcacatattcaatgtcttccctttcaagcgcggtcacttcgccgccggcagtcacgaccgcgactcgcgcattcccagtcccgatgtcaaatacaaggtagcctttttgttcagccattacagcctcctccttccgtttcaagttctcttttgttataaagttcacgtattgaataggtttgatcttgtttccatttgaaaagcgcttcatttaaaatcttcacatgatgatcttccacttcaaatgttgcgcccgctaaatggggagtcgcgaacacattcggcaaagagatcaaatcataatcagaagattcaggcggttcgtgataaaacacgtcaaggatcgctcccttaatccgccgttctttcagcacccgcagcagctcttccctgtctgtaaccgccgctcttgacgtattgacaaaaacagcttcctgtttcatcaattgaaagtgccgggcgccgataaggccgatggtttcttctgtgcgcggcaagtgaacggaaacaatatcactttcagaaaatacccgttcaatcgtcgttttttcatactcccggttttcatgacggacaaatggatcatagtaaagcaccttgcagtcaaaagcggccaatagcctggcgattctctgtccgacagctccgaaaccgataaggccgactgttttccccgtcagctcatttcctctgaatttgacgtaagcctgcaaataatcaccattccactttccgtccttcagccactgatgggaagaatacgtatgacgcaaaaatgaaatcacattcccgataaacatttcagcaacggcctgggcattgcgggccggtgtaaagaaaacggggatttttcttttagtcgccgccgcaatatccacattagacggcattcctctgcagacaccgataaaagcggaatccggcaatatgtcaataacacgctgagacacctcatcaagttcggttataagccccgacgcgtttgtctcttgaatcatccggatcaattcatcttcccgataggcccggccgtgcttcttccacggccggtgcacagtccggccgaacagctcagccagctccttcagcccctcgtcgtgatatggcgcggtaattaaaaccgtcatggtgcaaaacatccttttcacataaattttttcataaaaaaatctctttcctcaaagaaggaaagagattcatataccgtctttatacgcttgaagcgcacaaatatgtatagaccattctttcctatctttcaagcatacgcttgctggaattggcacaataaatgttgccgaggattcatagggccagtccctccacctctctggatagaaaataaaatgatgaaattgtcaggctgtttaaaagaataaactcatcatagaaaagtctttccgtaatgtcaacacttttttctgaattgacgttcgattttgaaatgttataatgcttacaatataaacaaagaggagaaatgggctatgaattctgctgcaacacagccgaacggggtctttaagtcggtgtgctcactagactgtcccgatcaatgcggcttgcttgtgacaaaaaaagacggaaaaatcgttaacattcagggagaccccgatcacccggtcacatcagggaatatttgcaacaaagtcagacacatggctgagcgtatttatgatgagaagcgcgtaaccgttccgttaaaaaggatcggtaaaaaaggtgaagccgcgtttgcgcctatttcctgggaggaagcaatcaatacgatcagttcgcgctggaaagagcttattgccgaagaaggagcggaaagcattcttccgtacagcttttacggcaatatgggaaaactggcggcagagggaatggaccgccgttttttccatcgtctcggagcgagtcatctcgaacggacgatctgcagcaaagccggttctgaaggctataactatacaatgggagaaggagcgggtactgatccggaggagaccatacatgctaagctctttattttttggggaatcaatgccgtcagcacgaatatgcaccaagtcatgattgctcaaaaagcccggaaaaaaggggctaagattgtcgttattgatgtacataagaaccaaaccggccggcttgctgattggtttattcccattcgtcccggcacagatgccgcactcgccctcggtatcatgcatgtcttattcgctgagaaccttcacgatgaagcatttctcacagaatacaccgaaggcagtgacgaattaaaagcgcatgtcaaacactatgatccggaaacggtttctgctattacaggcgttaaagccgacgatatcagacgccttgcgagaatgtacggggaaacctccccttcccttatcaggatcggaaacggcattcagcaccatgacaatggcggaatgatcgtccgcaccgtcgcctgccttccggctgttacaggacagtggctcaacaccggaggaggcgcaatcaagcacaacagcgcggtattaaactataacagacaagcgctccagcggcctgatctgctttacggccggaagccgcgatcatttaatatgaacaggctcggaagcgttcttttagaaacaaaaccgcccgtgcgctccctgtttatttacggtacgaatcccgcagtggttgcgccggaagcgaataaagtcagaaaaggcctgctgcgggaggatttatttacagtcgttcacgatctgtttttaacggaaaccgccaaatatgcggatatcgtgctccctgcttcatccgcttttgaaaacacggatttttacacgtcttactggcatcattttattcagctgcaaaaaccggtgatcgaaccctacggagacagcaaatcgaatacggaagtgttccgtctgcttgccggagcaatgggatttaccgagcaggagcttcaggattctgatgaagaattaatcagacaggcgctggactttcccgacaatccgtatatcgaggatattgattacgaagcgctctcaagccattccttcatgaaagccaaacggaaaaaaccgctttttccgggaaagctcaagacaccgagcggaagaattgaattatattcggaaaagatgaaacaggacggttatccggcgctgccgacacacatccctcttgagagcgatgacgattttccgcttttatttgtcccgggaccgaatcataattttttaaattcgacattttcaaataacgaaaaacacgtaaaactggaaaaagcgccaaaactttttattcatacagaagaggctgtacaccggaacatagaagacggagaaaccgttagagtttggaatcaccgcggagagtgcgaattgactgtttcggtcggcgaacaggtgcttcccggcgttgcggtgagccaaggtctttgggccgatatggatgataaaaaacagctcgtcaattcactcacgcccgatcggctggcggatatgggcggaggtgctgttttcttctccggaaaggtgcaggtggaaaagctcagcaatcaaaaccgtccgcaataaacgcccggcggttttgctgaaggctgaatcctccggccggcttcaccgtataaaaaatgataacgtttattggaggtttggatatattaccggcattggaatcgctttagccggatatttcatcggagacggattgaaaactttaactcacctgatcctcatgaatatctgacattccgcatatcacgagaaacggaaagcggtatgtgcagaaaccggcattaagagaatggctgacttccatgctggaaaaagaataacagctgctatgaaaagcgggaagagtttttctcttcccgttcattaagatttgccccactgcctctcttcaaccccaaacatacgacagatatcgttcttacgtaacgaaacatccccttcttttgatttcaaataaaaccctttcttatataaccgtatgacttcctcatatgtaagctcatgacgaaggaacgccattaaacgcccatctttttcatcttgtttattgaaccattcataccgttctgaccagttcactttctgaatgtcaaacaccttcccactttggattaatgcccttttcgcatttattatacttatttccccttttgtaaacactccgactgtctgtggcatttttgaaaacagccgtacccgccctattagtcaccatgttgacttatttcccttcgtgatgtatattgtaattgtcaacatggtgacaatttagatgggagataacttatggatattaaattactaatgaaggaactgcattttatgcaacaaagttacgcatcattattttcggttgtcaataaggtgcagactcggggggacgaatacttagaaatgttgacttcccgacagcacatgactcttattgctattgcccatttaccgacggaagataccacacttatgaatatcgctaaaaagctgggcacaacaaaacaaaccgctaacaaattaatttcaagtctctcgaaaaaaggatatgttcacactgtgccaagcaaactggataaacgtgcaatcaatattgagattacccctgaaggaaaaaaagcgttaatttcctgttcagaaagatccacctattttttagcggatatgtttcatgagttcacaactgaagaagttgaaacattctggaggctattgcaaaaactttatcgttttgatggtgaagaacaggacggttttgaagaaaaagcacatttgaaagttgaagaccaggcacaatccatctcagatgactatgaagaaaaaatcatggctgaattttcaaaacggcgatatgggagtgcaaacgatgaataatatgctttatcgaaaagtaaaagaaactgaggataagatgaaggaaaaatgctatgagctgaaagataaaattgatcaatttatttctcatgctaaatataaacttcattgcaatcgtaaactggaccgagccggcaattatatatcaattgccattggactctttatcctaactgcctcatggctgaccgcaacacaatggctgctttggataggcgcggcgagtattttgagtaatgcctgtttgctcattataaagcctgttaaaaattgaaaatctgaaaaaagctctctaaaagagagctttcttttattaatcgtcttagtcttcatcttcttcccgattttctttcatttcatgaagtctttcataaaagaactttataaaatgggcagaattaagttctttatagccaccgaattcactccaaataacaactggacattctcctttccgttactttaagtacatttattcacaaagtaatcttttttacaggtcatttagtggcagccccaggaaaatgcgaatttacaacgttaatcaaattcaaacataaaaaagtcgaattccctgtcctttaaggaaaacgacttttttatacggcttcttcaagtaaatccccattaaccttttttggggaagatttgtaacctctgcgcagtgaaattatacctgtgctagcccgccatctacgaacaattcaatacccgtcaagtaactgctttcgtctgaagcaaggaaagatacagcgttagctacttcttcaggtgtcccaacttttccagctggaacagtatttctggcattttccatcgctccttcaagtgcatcaccaaaaagctcatcgtatgcaggtgtaagaatcactcctggacttaccacatttacacggatttcagtaccttttaggtcaagaatccagttgcgaaccagtgctcttaatgctgctttagatgctccatatacactaaatgctgggttgccaattgatccagcggtggagcccgttacaataatagaacctactttgtccgggaatagtgataacgctttttgaacagtaaaaatggttcctttcacgttaatgccgaacgttctatcaacctgctcttcagtaatttcacctaatggaagaaagctgccgatgcctgcattagcaaaaaggatgtccaacttacctttttcctgctttatcatgtcatatagtttgtctaagtcttcaagcttagaaatatcaccttgaacaccggttacgttcttgccaatttggttaacagctttatcaagttcgttttgtctacgtcccgtgatataaacatatgcaccttcgtttacaaatttttgtgctgcagcaagaccaatcccacttgttccacccgttacaagcgctactttaccttcaaattcacccatacttaacactcctttagaattaatattattttatgtctagtacctttaagtacttgaagaacaacttacaagtaatagtatccttcagtaagcacattatcggaagtacccacttttttgtgatatagtaactaaaaagtaataaatgtggaatggagagctttagacatgaaaaaatttagctgtgggtttgaagtgacaaaggaagtgattggcggaaaatggaaaggccttgtattatactttttaatgaatggaccgaagagaacgagtgaattaaagcgcattatcccaaatataactcagaaaatgctgattcaaacacttagagagcttgaagccagtggacttgtgagcagaaagatgtataaccaagtaccgccgaaggttgaatattcatccactgaacttggagaatctcttaaacctatcttgcaggagctctgtcaatggggagaccattatgcggagcaaaagtatgcagaaggtgaatatgaaattgtacagccagaacaactaagttaggattgatgcagctgctgaagtaaatgctaaacaacttcaataccatcacctaacagatgaagaacagtcagaaataaatgagatattcaattttgaaagtgaagttataataagaagtgtcatggactatattcaggagaactttgatgaaattcaaaaaagagctgtttcaaatgttaaagagaaggttcagaaacttagccaaaagataaatgaagacatcagtaataacatttaatgcctatatggtctcttcgcatgcatcttttacacaaaaagacccggattttaattccaggtcacacttcggtcacaacttgctcaaattccctcttgcatttgtcgaactgctttattcaagatcataaaatttcaaacgaaccttacacgaaggaatcggggatcggcaaaacaaagccagatataacatatattaaaaaatctcttgcatttccacaccggccatgctatattcatatagcgatgagctgaattgtgtaagccgatgcacatgcccttgcggcacacacgaatgtggcgtgtggtgtatcgcctcaatacgcaaaagacgtttgcttctgcaaacgtctttttttattatccgattttcgttccgttcggtactgactgctctggcgtaagcaggacaacatctcctttttccgggatgccgccaagaacgagaacttctgacttaaatccggcgatccgccgcggcggaaagttgacaatagcggtaacctgcctgcctgtcagatcacccggttcgtaccgttttgtaatctgggcgcttgattgtttcatgccgatctcttcgccgaaatctattgtcatcttaatggccggcacctttgcttccgggaatacttccgcttttacgaccgttcctattctgagatcgagcttgataaaatcttcgatgactgccatatcaaaaactccttttttacaatcatgataccaaaaaaagacgcagtttatttaactgattttcaggattatttatcagattgaaaggtgtttcggaagacgcgcggcgttattcccttatgtctgacaaaccatctggtaaaggaagacaaattttgaaagccgacctcctgactgatgtctgtcagccggcattttgtttcaataagcatttgttccgctttcttcatacggagctcagcaatataagcttgcgggcttttccctgtctgctttttaaaccagtcggaataatacgccgggtggtaatgttccattgcggcaagctctttaattgaaaaagtctttgagagatttcggcggatatacgcaattgaatcattcgtacggttttcttgtatcttttcagcaatatattctgcaagcagactcaatgaatgagccgactgctgcttagtctcttctgtcagcagaaaccgaatcgatgtccaaaaagaatcaagcttattcagaacgccgggatcaaatgaacctttgaaaaaatatgccggtatgtcgagaacgagacattcgtttcgctccaaagaacggaaccgatgttcatgcccgggcggaatatacagcatttgatcaggttttaatctgatttcacgtctttctgtctccaagtccagctgtccttcgagcggaaagagcatttggcagtatgtgtgtgcatgagaatcaaaaatatgtgaataggtgcgccgctcacaaatgatatgttgtaatgaatccatttgtccctccttttactgatgcgtttttttatttagtttacataataatattattgttacctaccctgtaaacctcttaggaaagcaacaactgcaaacttccggctttccttaattgattcggttaattcaaatgcactctgttttctcaacacggcaaagccgtgaagaaggctcctcagtcctctcgcagcatgaatcgcagtgtcagactgtgcataaccgttagctgtcagctgcctgacaacaagctctacaagcaggcttgacagattctcaatccggccgtcttttatcttttgaaatgttgcgtcatataatccgggattggcttcggcgaaattgatataggcatcggcaagagcgagcaaagccgtttcacccgtcagtccttctgcagaggccgccattttttcaaataacatagttaaaccggagacagccagctctgttttaattccttgaaggccattgacaaaattgtaaagggaaggcggttttacgtttaaggactttgcaacggccgcaagcgtcacttcgttcagcccttttttgtcagcgatgcctgctgcggctctcaatatcatgtcaaggctcattccgactctcggtgacattatgatcggcctcccggcaggcttcgttcagcttcctcagcagcctcagccatcatttcaacgggattgcagagaacatttccatgtccggcggccagactgcttggttgatgagcgataagcgttcttgctgtttttacagcttcttctttattccacgtagcaaaagccggaaacggaaatttccatttcagcttccctgaaacagcaaggccgccccgtacttgaaaggcatctccgacgatcagcatatcatttctcatatctttaaaagcgaggcttcccggcgtatgaccgggagcgggaatgacaagtaaagatccgatccgctcgccgcctttcagcaggcgatcaggttcggtctgaacatttttcggcactcccccctttatcggcgtttgtgcttcatgctcaaataatgaagtgtcacctttcagcaagaaagaatcccgctcagaaatacagacggaggcatccggaaattccgcagctaatgagtcaagcgaaccgatgtgatccccgtgcgcgtgggtgagtaatatgtcattcagcggcttcccaagctgccgcaatgcttgtttgattcctttatgactgttaggcagtccggcgtcaatcagggttactcctacttcttcttcgaccaaataacaattcaccgggaaaagcgctggaaaaaaagtcagctgccaaacccttccgtattgtaagattctcatcaacatccccctaaaactaatatcgttagttttattataactaataccgttagtttatcaagagttttctgtttaaatcctgaaaaaggcgcgggcgcttctcttatgcaaaaaaaagaaacgcgcatactgtgataaaagatgctttcagcctgcgaataaatcagactactaaaaccagccggataagcatacactactcaacggagggggagtttcacaccatgcatatcacacttcaaagcatctgccctgtcttaatgattgccttttttctgtataaaaaggtgaaacggtccgtcggctttcagcctttgaaaccccgctggctttatacaagaatgattttgttttcattgctggccgcagctctggcgtttttcagcatcacacacccggctttatacggccatcttatattcggcactttttgcggctggcttctggtcctgtttgccaaacggaatatttcttttgaagaacgccgcggaaaaatgtattttcgcactcatctgtggattgaacttattctattaacgtttttcctatcgagatttgtttatcgcgttattgaaatttaccgggtcacagcggactttacccatccggaggcatacagccaaacggtcggggccgatccgctgaccatcagtatcttttatttcatcgcagtttattacagcggcttctctttttatgttttaaaaacgagcagagaccaaaccaataacagtcagtacggctgacatccctgtctaaaaagcagggatgttttttaatcgtgccgcgtatggtgaatcatttgctgaagcacatctaacacatgttcatcctcaggagaataatagatggatgttccttctctgcgtgatttgacgaggcgtagatttttaagaaaacgcagctgatgagaaacggtagactgcagcaaattcagcttttctgcgatatcatttaccgcgtgttcaccctgtgacagcaaatggagaattctgattctggtcggatcagacagcgccttaaaagtctgggcaaccaaaaataaagtttcctcatctaaatcgacagcggggtcattcgtctttccggattcgtgaaattcagtcatatacctcacccttcttttctcaagtagcccaattataccaaatgtcaattgatgcagatacatcctgcgcctgacaaaagaaccgttattttaaatttatgtttcaaatacgggtttccgcttggtttcgcgcatccatctgtgtcataatgaaaaagtcataatgctcctgaaattgagggtgaaacacagtggagaaaaagaaaaaaggctgtttcgctgccgcgggtcttatgatgatatgtgtttttgtcatggtttccttcttcctcattctgttattttcaaataatgaatggctcaaaagtcttccgtttgatgtcaaaccgatcgtgcttgaacggctgacagattacaaaccgcttgttgaagacgagctggatgaaaaaggactcaccaaatatacatcgcttgtactcggcatgatatatcaggagtcaaaaggaagaggaaatgatcccatgcagtcttcagaatctctgggtttaaagcgaaatgagattaaaaaccctcaaaccagtatcaaacagggaatcaaacaattcactctcatgtaccaaacaggcaagaaaaaaggcgtagacttggatacgattatacaaagctacaacatgggagccggctatattgattttgtggctgaacatggaggatcgcatactgaggaactggcaaaacaatactccgagcagcaggtcaaaaagaatccgaaactttacacttgcggagggaacaaagacaatttccgttatccctactgctatggtgattacacgtacgcagaaaaagtaaaagcaaaaacaaaaaccgttgaacaatccttaaatgtaacaacacttgaaacgcttgaagagtaaaaggcgccctgatgaggcgcctttttccatcaatagaaaaaagccgcgcagagcacggctttttttaataatacggtgagatcattaagtatacaatgacacccgtcagactgacatacagccagagcggcatcgtccatctcgcgatttttttgtggcgctccacctgcatgctgaatcctctgatcagcgtaaacagcgcaagcggcacgataacggcggaaagacagatgtgcgtaatcaaaataaagaaataaatcccccgaatgatgccgtggccgccgaataaagtattctcagctatcgagtggtacacgacatagcagatcaaaaacagcagagtcgtcgtaaacgccgccaaaataaagcgtttatgcgcttgaatatttttttgcttaatcataaagagcgctgccagcaaaaagataaaagtaaagctgttaaaaatagcatttaacatcggcagaatatgaatattggcaatgctgacctgtcccgatttcggcataaaaaacagcaccgcaattaacccgttgatcaaaacggtcaatgtcagcacgataccggtataacttttaggtttgttttctgtctgattcatcttatgacctctctcaattttactgactatccaaatggtatgagaattcagctttgatgtcaacggtttcgtccgcttcgtcagaaattagacaaacttaagccctaaaaagaccgggtgtttgagacccggcctttcgtcatattatgcttccttcaacagttcttctatcactttatgttcgttttcattcaacagattttttggaatgatccgatctatcggtttattcatatgctgatcgagaatatcggctgtttctttgtcccctgcgattacgagacgctcccattggtgtgaagcggccttttgatcaaggtttgaagccaatcgtttatacagcctgttttggttttcttcgacatgggctttggcggcgtcttcgtccattgatgcggagcttccgcttacatcctgcggtttccacgattcattgatgacgtcgtattgataatgctccaccccttcaatttttccgagtacggtttctatgatcttcacttcattctgctgggtgagaataaaagccgtgcttggaaattgttcacggagaagttctaattgatcaaggacagccgtttcttcccaataaaatcgtgtttcgacaggcacctgcaattcaatcgtctcccagacaccgccttcccccgatgcaaaaaatacgaggcttcgcggcatctctttaccaagcccatcgatatattgatagacacgttgcatgatgcggacgagagatttttcttcttccggatcacttacagacagatactcttttaatctccgaaaaccggttttcaaggcgattttccactctcccccctgctgatccggatttctcatatccgtatttacatataaggaaagcattttatcaggagattccgtcattacgtacttcaatttgccgatgagtgagtcaattgccattatagattcctcctttttccgctgctcactgttcctttccctatccccaccgccttaaaaacgtcaatccacatataaacggcagacttttctaaaaaagtttttgcaaaacccatttacaaaccaagacatcatttactacaatggatacttgtgtttgactaagacttttacgctgtgaaaggagtatgattttgtttactgcagaagaaagagatcagaaagagctggaaaaagagcttcataaacttgaatttcagattttcagaatgcgggaaaatctgatagatgtatcaaaagacgcgcgagtgcttggtattgatcaatcgaacaatgacgattggatcattgtttcctcgattgatgatggccaaacatgtaagattatgctgactgattgtgaatcagcctaccggggaagaggctgtttttcactgatcgcttcttattatgacaatgccattcatatcggggatattaaaggcccgccgaaccacggctacggctcgatctgcatgaaatttttaaaacatatcgccagagagcagaatatcccgaaagtgacgggcgacatcgctaagcgtgattgggatcatgtcgaccggctcgttcatttttatgaaaagcatcaatttgatgtctggattgacaatgatacgcaatcaggcggcattaaatgggtcgacctgtaaaaaatgatagataaaccctcgttaatatggtgtaatagattaaaccatttaaggagggttttttttgtatccggaaaaattgaaaaaaggcgacggcatccgtattgtgtctccggccacaagcatgtccgctatgtcagatgaaaatataaatgccgcgaagacaaaattggaggagctgggcttttgtgtctctttttcagagaatgcgaaagaaataaatgaatttcattcatcatcgattgaatcgcgtgtacgggatctgcacgaagctttcgctgatcctgacatcaaagcgattttgacgacactcggcgggttccaatcaaatcagctgctccgctacgttgattatgaaaacatcaagcggcatccgaaaatcctttgcggctattcagatattaccgctctcggccatgccatatatcaaaaaaccggccttattacatattccggtccccatttttcttcatttgccatgaaaaaagggctggactatacgattgactctttcttggcctgctgtgcttctgacaacccgtatgaggtaaaaccttcatccgagtggagtgatgataaatggtatttgaaccaggaggacagacgtttttatcggaatccgggaccgctcgttattcagcccggatatgcggaaggaacactgatcggaggaaatctatgcacgctgaatcttctgcagggcaccgaatactttccggagatggaacaagtgattctgtttatagaagatgatcatatgtcggacattcatatgtttgaccgggatttgcagtcactcatccatcttcccgctttttcagccgtgaagggaattgtcatcggacgtttccagcatgcttcaaatgtgtctgaggaggctctgcgtgccgtcatccgtacaaaagaagaactgtcatccatgcctgttatcgcaaatgctgatttcggccatacctcccctttgatgacattcccgatcggaggagcatgcaggatagaagccggctcagaaggcggacggatatggatcgatcggcattaatacataaagacgggaaaaccgccccgtctttttattttgacgccttatgccgcggcgtgcgaggagcgatcataattcgtccgccagccgctgccctcacccatacggaagctccttcataaaaacggctgatctcttcattatatacggcgtgtgtcagttcacgtttatcatgcgttccgtcttggttttttacgtttaaaataagtacaagctcgtgcctgccattcttcatcacgccagtacgtctcaccttttcaataacggctggccttcctctccctctgtcaagcgcctgaaacagcctgacagcaggcatagacagtccgataacgagcacaatggcgaaagcggtgcatatacctgcttgaaacaccggtgattctgtgaaggtattccataaacatatacattccggctccatcagattcatcccttccgattcttttttcacatccattccttattatattagagaaacgctttttctttttccgcatataacgattatatacagtcaaaaaagggaagaaaaaaagaacacaaagcatttcgccttgtgttcttcatctctatatgaaactagtctaatactttaacatttactgttctgacgccccagttgttagcgtcacttttctttgcaacaaatacgtcaattttatttcctttaattgcgccgcctgtatctgctgctgttgccactccgtaaccttcaacataaaccttagagccaagcggaatgacactagggtctaccgcgatgacttttgcatcagggtttttgtttaagtcaacaccggttgccgttacaccggaaatgccgccgtcgttagcagagtaagcagttgcagtcattgtcatctgctttttaggctcttgttggtttgtatttgattgaacaggctgctgttttgcttcgacagccttcgcttcttgtttaggttgttgttgttcttgaacaggttcttgtttaggctgctcgtttttgacagcttcttgtttcggctgttctgtctcagcagctggtttttgttcagtttgcggctggctggcttcttgagccggctgtgcagcctgagcctgagcctgacctttcacatttaacgttgtgcctgcgtaaattatatctgattgcaagttattcaagcttttcagattgccgactgatgttccgaatttctgagcaattttccagaggctgtcgccctgcttcactgtgtactgcccagatgtggttgtttctactgaagaaatagtcagtttctctccttcaatgattaaatcagaagataactgattccattcttttaagtcctttaggttcactccgtttttttgcgagatcccccagagcgtgtcacccttttgcaccgtgatttctttagcagaagcgtgagctccaaatgcagttgttgaaattgctgcaactgcgacaaaggacataatcgtcttcttcataagtaaatcctcccttgttagctttttattggcggctaacaggtgatatcgtaacatatgaaaatgtcagttcaataacaaaacgatttgaattagattacagttcctttacatgaaacatttctctcgcttggtaagtcttgctgaaaccttgatacagcaagggttttcaagcttctgatttttccggcgcccatgaaaaacacaatgtgcaaatttctaaaaaaactttttttcactctgtttctcttacataatttcggatttcttctaaaaaaaccgctccgtatttcaatcttttttgttccccgaccccttttacggaaagaagatcctgatctgttttcggaagtttcgccgacatttcttttaacgtctgatctgagaacacgacaaatggaggcacaccctgttcagctgcaatctctttgcggagacgccggagaagctcaaataattcatcattttcggtgacggcggcggcctgtaaggcttcttttctcgcgactgcgctttttccaagcagaacgtccctgcctttttgggtgaccataagcgtgggaaatgtgccgtccgccattctgatatattcatctgaaataagaaattcgataaaatcactgatttccgctgcggattgatgcttcataatgccgtaagtggacaggctgctgaagccgttttccagcacttttttatttttagacccgctaagcacctgcgccaccatcgtttttccgaagcgctcattcattctgatgatgcatgacaataccatctgcgcttcttttgtaacgtcatgggcggtccttgtatcagtgcaattgccgcacgcttcgcaagcttccgcctcattctcgccgaaatacttcagaataaaccgctgcaggcaatcttccgtatgacagtaatccaccatctgtctcagttttttgagatcctgcttttgtttttcttctccggcggccgattggtctattaaaaaacgctgcaccataatatcctgcggcgaaaataagagcacacactcgctgttaagaccgtcgcgcccggcccgtccggcttcctggtaatagctctccatatctttcggaatctgcgcgtgtaaaacaaacctgatgttgctcttatcgattcccattccgaaagcggacgtagctaccatcacttgtatctgatcgttaagaaaacgctcctgctggtcttttctgtcatcatccgccaatccgccgtgataacggccggcattgatgccgctgcgttttaatttctcatataaacggtcggtttcttttcttgtcgctgtatatataatgccggcttcgtgtttatttttttcgaggtaccgctcgataaaccggtctttgttttcgccctttactactttaaacgttaaattctctctggcaaaaccggtatatacagtttgttctttcttaatatgaagctgcttgcagatgtcatcatgaacctcaggcgtagccgtcgccgttaaggcgatgatgacgggcggttcttttaattcattaaaaaggatttcgatattccggtaactcggcctgaaatcatgtccccattgcgatatacagtgagcttcgtcaattgcgacaagaggaaccgtaatattctgcaggatgtgaatgaattcagaagaagtcaaacgctccggtgtgatgtaaaagagccggtaagccccttgtttcaaaccggtcaggcgctcatgaatgtcacggcttgtctgggtgctgttaatataagctgccgcgatacccgcttcttcaagcgcgtcgacttgatctttcattaaggaaataagaggggaaataacgattgtggttccttcaaacagcagtgcgggaatctgatagcagattgattttccgccccccgtcggcataatgcagaccgtgttttttctctcctctgcaactgattgtatcgcctgcttttggcccgcgcgaagactgtcgtagccaaaataatgcgccagaagggattgggctttatccagcatatgttgtaaaacctcactttgtctttgattctttcattttatcatactgataaagtacgctgctcaagggcaattcaaaataaaaagccatctccgcaagggaaatggctttcgctacgtatgccgtacgcaagtaagaaagttttaaaccaccactcctcaaagtgggtgtttgcagaagcgttcctgtcgtcctctgcaatggaggcatgacattccggcttcgatataaaactccctattacagcttaaaggttaaaacttaattaacaatacgaacaatgtagcttctcttatatcctacaccatcagtcgtattttggcaagagggttaattcttttacagaaaaccttttttctttgtgaaaaatgctttattctacataaaaattgttttttcgacaaaatatcaatatatcaatataagattgaatcgaaagctgccgccagtttcttctataatagaaaaaactctcacaccctgtaggggcgcaagagttatggcaattagaattttgcagccagatctttcgcttcttgcagtcctttttcaatgatcgcttgagcgttatccggtgcagcattatgaccttcaacgacaacagtgtgaagatcttggacaccccagaaaccaagaacggttttcatgaagtttaatgacatttcaagagatgccatcggtccttcagaatatacgccgccgcgtgcgtttaagagcgctacttttttatctcccatcagacctttagggccttcaggcgtgtatgtgaaagtaacccctgcgcgagacaggtaatcaacataagtatgaagcacagcaggcactgtgaagttccaaagcgggaatgcaaacacgactttgtcagctttaacaaattgatttaagtaaatgtcagcagttgacgcttgttttttctcttcgtctgtcatttcaattcctttagaagctttgaatgttccgttaatcatatctcttccgaggtaaggaaggttttctttatgaagatcaagttcgatcacttcatcattcggattgttttctttataagcagccagaaacgcttcgtataattttacggatacgccttcttcagccgtacggtcgcttgattttacaaataatacttgagacattctaaattcctcccggtaatcttttaatatttacttacaaatagtatgttactttcttttttatataaagtcaatgattttatttcgattctgagattttttatggaataaaaaaacaggtacatatgaatgtacctgctgctattattgtgaatcctgctcgcgatccaggatttcgtaagtttgtgagcttttttgatcaacggtttctttatttgagaggtctttcacctgctcgtgaaattccctttcatatgacggagcgtctgttttcacatccccttctgtttctcgctgcgcttcgacggtcattctggcgtacggtacggcttcaagtctttcataaggaatttcttttcccgttttctcgcaaatcccgtatgttcctttatccattcgttcaagcgcggcgttcacctcatctaaaagattctgatcgacaccgtccagcgtctgattcgtgaccctgtccaaataaatgcttccgtgatcagctaagtgattatctactccgttcgacagttctcctgtgtcttcgctcattgaatgattttctttggattctccctgaagactttcctttaaatcgattaatttatgataaaggctgtcctgctgttcttttgataatgccatattcatcatctcctttttcgtctgtattcttcgctgcatctgttaatacataccctcgaaaaaggaggatgaaacaatgggggtcaatgctttctccccctgatggtgacattgggtgtctgctgctttgtctgtcttttttctttcgcagcatcattttgcgggttgtcccgactttcttcagcgcaggcttgtttgagcctgtgcgccggtgtatggtaagtggcgccgatattcagcataccgctcagctcttctatactcagctgttcaaaatcaatattgtattcaatcttgtccactttgacgtgctcaatatggacatatgttttttccccttcaaccgtttgcggctcaaaatgacacttatcctgaagctcatcaagctgttgttccactttcttaagccggtctaattcttcttcacacacttttttgaaaatctctttcattatttttttcaaagaaaatcacttctttccccgtcactcttggaaagttctatgcgtcccgtattgcgaatatataaacatgatatacaaaaaggaggcgaatcatgatgttttttccatccgttatcaactttgagtatataaaaatgaacggaatcagcggcggagcggcttttaacaccggctcttccgttatggtgagaaacacagcagccaataaaagaaatgaagggtacggtgaacaaaacggtgattgcaccgttgtcgccatccctatcatgagtatcgatgattcagatctgatagatggcacagcgaacaagatcagccttcgataatgatctggcttgcatcccccagatgtttagcaatcgatatatataaaatcccgtctttgaataccgcctgcattcccttcgtaccttgagcggaatgcggaagatcgagttttttttcaaaatcgccgtattttccggtcttctgtttaaaatcctgttcattgaaaaaggattttctcgtgccttttacgacaatatattctccgtaggacaacagctgaacatcttgtttccggtagccgggcagatacagcaaaaattggagctcatcatgggtttccacaatatctataagaggaaaagcatcctcatttcttctcatttgcccatctccctgttgaaagggaaaatgagaatggccgttttgaaatgatttcagttgttcatcatcaaaaacgtttttccaaaagtcgccgccggacatgttttgcgccatttccatccattgcttcatcttatcgaaatccatttttatcgccccctgtctaagcatacggtcataacagccggcatacacctgtattaaaggaggtttgcctgtggttcaaccaactccatatatcaatattaatattttcatgttgaaaattaattcctttgaaaatgcttcagcggtgaatgtcggacaaaatttactggcggaatggcagaattctgataaaaagaatcagggatacggacagaacttcggagatgcaagcggcttcatcggcacgaacggcaaagtggatgaccgggatcaaattgattctccatcaacctttgagtctgcatgcgacaaaatccctgccggaaaaggaggcccattatgatgttttcgccggttttggtaaatgtaggaggctttaaagtaaatgcggtcgaccgcggttcttccattacgatcggcccgtatcagcaaatcgattattttttatccaataagatcaactacggattcggtgaagaaaatggtgatttggcgccgatttatatccccatcagttctatcgctgacccggatctcattgattcgaactccggaaaaacaagcattatataataaaaaggccatccgcatgcattcggatggcttttatgtgatatttaactgcataagtattttgttaagatggcttgaacctcagtcaagtccgtttcttttgcaaattccaattcgaaagtttttccccttgtcattaatacaagcccggtatcgggatcaaacatccccgcttcttgaatggcgaagctttcaattgttttatatggaagaaatacgcgcactttctttttggagaacattttattatcaaagaaaatcactcgtttattcgtaaagcatatttggtcaacccgcagtttataaatcgtttcgatccgttctccctcaacgagcaaagcctccagcttttttgtgtcggttgatctgctgacagaaaaaattcccaatgaagaaccccactttctgcttctatactattgttttattacaatcataaaaaataagttctttatccctatataagaatacgacatagacggcatttaaaccattacgaacagattacatttttagaacgttcatcaaaaaagcccttcgcgaaaggtgccgcagttatgaagtaatacggttcagcggaagaaaaggtttcaagaaaacggtatttttttcgaaaagtcagttttttattttcgccataaaaaaccgcggcttctccaatgccgcggtttcaacaaaacatcaacgatccgtatcttcaattgttccttctttataggtatctgaaatttgttccatcgtcgtgtcggtgccttcttcaggttgcacttgctgaagctgatctgatgttttattttgtttgtcttgctctgtttttttcattttgcagccaccctttatatgtagtcttttttagtatggctcaggcaaaatgaattcattcagccttaaacttcttcaaaatactctttgtagaagcctccgactttgtttgtattgtctgcaacaaaaatgaattcttctgtttcatttttgacttcatactctttacccggcgtcagcacatttttgacaatgtattttttcgcatctgtatgtacgcatttgacctttttgacgctttcttttgtctgccaattattatgaatcatttataaaactccttttcttaatcgataagcttattgtagccgttttttcttgtgaattgcaataacggttatcgattgattttaccgggggtgttattatagaatgactgtatgcgcttactttgcgcggacatcaagatgctcaaaacagaccataaaaaatttcgggaggtttgttacgaatgagttctttaacgatgcagatcacaaaaaggctggaaacatttttacagggtacgaagaaactttatattgacggaaaatttgttccgagcgcttcaggatcaacatttgtcacaccgaatccggcaaccggagaaacgctgatgacgctttacgaggcacagacagaagacattgacagtgcagtgaaagcggcacgcaaagcctttgatcacggcgaatggcgcactatgccggccgcttccagaagcaggctgatgtataagcttgccgatttaatggaagagcacaaaacggaactcgcgcagcttgaaacacttgataacggaaaaccgattaatgaaacgacgaatggggatatcccgctcgcaattgagcatatgcgttattatgccgggtggtctacaaagataaccggacaaacgattccggtcgccggctcatattttaattacacccgccatgagcctgtcggcgtcgtggggcagatcatcccttggaactttccgctccttatggcgatgtggaaaatgggcgccgcccttgccacaggctgcacaatcgttttgaaaccggcggagcagacaccgctgaccgccctctatttagcggaattaatagatcaggcgggcttccctgacggcgtcatcaatattgtcccagggttcggcgagacggccggggaagcgctgaccaaccatgacgatgtcgataaactcgcttttaccggttctacagaaatcggcaaaaaaatcatggaaaaagccgcaaaaaaaattaaacgcgtgacactggagcttggcggaaagtcacctaacatcattttgcctgatgccaatttgaagaaagccattcccggcgctttaaacggggtcatgtttaatcagggacaggtatgctgcgcaggctcccgtgtcttcattcacaaagacaaatatgatgaggtcgtcagcgaaatggtttcatatgcgaaatcgcttcagcaaggcgccggccttcaccaagatacacaaatcggcccgctcgtcagccaggaacagcatgagcgcgtgctttcatatattgaaaaaggaaaagcggaaggagccaaagctgtcgcgggcggcagctgcccgtttgaagaagggtattttgtctccccgactgtatttgcggatgtggatgacagcatgaccatcgcaaaagaagaaattttcggcccggtcttagccgccattccgtatgatacggttgatgaagtcattgagcgggcgaaccgctcggaatacggtcttgcagccggactttggactgaaaatgtgaaaaacgctcattacattgctgaccgtctccaagccggcaccgtttgggtcaactgctacaatgttttcgatgcggcatctcctttcggcggctataagcaatccggcctcgggcgggaaatgggctcttacgcgctgaataattatacagaagtgaaaagcgtctggatcaacctggaagattaaatcaaacaagaaactgctgcctgtcagcagtttctttcttttgtcatgccgccttttacatatgaatatatatgcttctgaaggagttgagcgagtgtgagcacaattcatgaaaacgtcagaagccgccaaaagaaaaccatctccctattaagagaaacgcaaaatgcggacggctcatggtcattttgttttgaaggtccgattttgacaaacgcctttctgatcctccttctcacttctcttggagacaatgataaagaactgatcgctgagcttgcagaaggcattcgcgctaaacagcgcccggacggaacttttgccaactatcctgatgaccggaaaggaaatgtgaccgctactgtacagggctatgccggcttgctggcttccggtttatatagccgttctgaggcgcatatgattcaggctgaacgctttatcatctcaaatggcggcttgcgcaacgtacacttcatgacaaagtggatgcttgcggcaaacggcctttacccatggcccgcgctgcatctgccattatctttcttagtcattcccccatccttcccgctgcatttttaccagttcagtacatacgctcgtattcatttcgtaccgatggccgtgacgcttaacaaaagattttcgctgaaaaatcccaatgttccgtctctcgcgcatttagatcggcatatgactaaaaatccgtttacatggcttcgttccgatcatgatgagaacagagacctctcttctcttttcgcgcactggaagcggcttttgcagattcctgccgcttttcaccagctcggtctgcgtacggccaaaacgtatatgcttgaccggattgaagaagacggcacattatacagctatgcgagtgccactatttttatggtgtacggcctgctcgctctcggtgtatcgcgccactcccccgttatcagaaaagcgcttgccggcacgaaagctttgctcacgtcttgcagcgatataccgtacctggaaaattcaacgtcgaccgtttgggatacggcgcttctcagctatgcgcttatgaaaagcggcatctcagataacgatcaaatgataaccggagccgcccggtttctgcgtgaacggcagcagacgaaagtcgctgattgggccgttcacaacccgcatgctgaaccgggaggatggggtttttcaaacattaatacaaataatcctgattgtgatgacacagccgcagtgctcaaagccatcccgcgaaaacgttatcccgcctcatgggaacgcggactgagctggcttttgtccatgcaaaacagtgacggcggcttctctgcttttgagaaaaatgtcaatcatccgctggtccgcctgctgccgctggaatcggctgaggaagctgccatcgatccttcaacaagcgacttaaccggacgggtgctgcactgtttaggagaagcggggctttctcctgatcaccctcagattgaaaaggccgtccaatggctgatccgccatcaagaagaggacggatcgtggtacggcagatggggtgtctgctatatttacggcacatgggcagcgctgacagggatgaaggcttgcggcgtgagccaaaaccacccggccgtgaaaaaagcgatccgctggctgaagtccattcaaaacgaggacggaagctggggagaatcctgtaaaagcgcagaagtcaaaacctatgttccgctttcttacgggacgcttgtacagacggcttgggcggccgaagctttgctgcaatacgaaaaacctcatcatcaagccgtcacaaaaggcatatcttttcttattgaaaaccggcattacgaaggagacgctttcagctatccgaccggaatcggcctgccgaaacagttttacatcaggtatcacagctacccgtatgtgttttctttgcttgcgctcagcacttttatgaaagtgagtgaaaaggaggaagaaaaatgaaacggcacgcttatcaaaccgaaatgctgaattggtgtgaaaccttgaaggaacaagtcatacagcaaggtcggttcgatcgcttcgcggcacaaatcgaccggatttttcacacccttcaggatgatggattaacggaggcggaatggtacgaacaggcatcagcactttaccgggacattaccgaaccggaagagccggatgagcgcagagcctatgtgccgatcggcaagcatgtcctccctaaactgccatacagttattccgcactggaaccgtatatttcaagagagattatgaaactccaccatactaaacaccatcagagctatgttgacggtctgaataaagcagaactggagctcaaaaaagcgagacaaacgaaacagtacgacttagtggcgcattgggagcggcaattggcgtttcacggtgccggccattatttgcacagtattttttggttttccatgaatccaaacggaaaaagacggccgacgggtgcgctctttcaaatgattgatgtgtcattcggaagctattccgcttttaaagagcaattttctcaagcagcaaaaaaagtcgaaggagtcggctgggctatccttgtctgggcgccgcgctccgggcggctggagattttggccgctgagaagcatcagctctacagccaatgggacgtcattcctttgcttccgctggatgtatgggaacacgcctattatttacaatataaaaacgaccgcgcggcttacgtggatcaatggtggaatgtcgttgattggcgggaggcggagaaacggttcgagcaagcgcaccgcgtgatgtggccgctttattaaaaaaggcccccgtcttgaacgggggcctgcttcttttggtctaaaaaataccaagcacgtgcagaaaaacgataataatggctacaggagccacataacggattaataggagccagactgcaaaccattttcgttttataccggaaccgcttttcagttcgtcaaacagcatctgtttcggaattttcagcggtacgaacacggcaattaaaagcgcgcccaacggcattaagacattgctgaccagaaaatccgcagcgtcaaaaatactgcggtgaaaaatagaaacatcactcaaaatgccgtacgacagcgccgaagggaccccgacaataaatatagcaagtcccccgatccatgcataccgcttccgttttgccgaatcgccttttgacaaaacagcaactaaaatttcaagcattgaaaaagccgatgtcagcgtcgcaaataaaaacagcagcaaaaaggcgagtaaaaacacgatgcccaacggcatttggttaaagacggtcggcagcacgttaaataaaagctgcggaccttgatccggcttgagaccgaatgcaaataccgccggaaaaatcgccactcccgccatcacggcaacaaggacatttaataccgtcaccgatacggcggattgaacaatattttcttctttttctaaatatgcgctgtatgtaaccattacggacactccgacgcttaacgagaaaaatgattgacccatcgcatataaaatggtattggcatccatcgcgccaaaatcaggcatgaagaagaattttaatcccttcgctgcatcatgcagcgtaacggagcggatcattaaaagaataaacagaataaacagagccggcatcagcacctggcttaccttttcgatgccgctgctcaccccttttgccacaactaaaatcgtcagcacgataaacagcagctgaccgaaaaccgctgcataagggtttgaaatggtatcgataaataacgtatcaaatcccgaagaaagcgttaaaccgcctgtaaagccttttataatgtagattaatatccatccccccactacgctgtagaaggataatagaataaaacacgttatgattccgagatatccgatccagtgccactttttccccggcgccagcgccttataggattcaacggcgtttttttgtgtttttctgccgataataaattcagcaagcaaaagcggcagtccgattaaaacagtaaataaaataaaaacaagcagaaaagcgccgcctccgctggttcccgctacgtaagggaacttccatattgcgccgagcccgattgcagagccggccgtagctaaaataaatcccagcttagatgaccattgattagcttctttcacttcagcactcccaattcatttcagtataaaaatcaattgtaagaatatatgtctgaatagtcaagaagatattagtttacataataattttatcgaaaacttatatttaatattgaattattcagaatattatttataatggagtacagaaaagtcagtcatattttctgactgattgattggatgtaaaaggagctgtgtttatggaatggctgaaaaaaataagcgggtttgcgggccaaacctttggcttgtgggttatcgtctttgccggtttgggattcgcctgccctgatttgttttcttggatcagttcttatatgacgattttccttggtattattatgtttgggatggggcttactcttcaagcagacgattttaaagaattaatcagaaagccttggcatgtcgtgatcggagtcgctgcccagtttacgattatgccgcttgcggctttctgtttatcagtcgggctccgcctccccgcagaaatcgccgcgggcgtcattctggtcggatgctgtccgggcggtacggcatcaaatgtcatgacgtttttggcgaaaggcaatacggcgctttctgttgcggtcaccacgatctcaacattgcttgctcctattgtaacgccggcacttattatgctgtttgcgaaagagtggcttcccgtttctttcggttcactgtttgtttccattatgcaagccgtgcttttgccgatcgtcctcggggtgattgtgaagctgttcttcaaaaaacaggtcggacaagccgtgcacgcacttcctctcgtatcggtaatcggcatcgtagcgattgtatcctctgtcgtcagcgtaaatcgtgagcatctgcttcaatccggactgctgattgtgtctgtcgtcatcttacataacggaatcggatatttgttaggattcctgactgcaaagctgttcagaatggattatgcttcacaaaaagcgattgcgatagaagtcggaatgcaaaactccggactgggcgcagcgcttgcgacagcgcatttctcccctttgtcagccgtgccgagcgcaattttcagcatatggcacaatctgtcggggtctgttcttgccacctactggtctaagaaaaaagagaaaaacagcgccgaagaagaaacggcaaagattccgttttcataactgaacaaggataggctgccgccgctcctatccttgattattctgcagatcacgaaacaggcgcaaaagcgctttttttacatccccctgaaataaacctccatgataacaaatcaattggcggatatcgtaatcaagcagccgctgcacagatcggaccgcatcatccatatgtaacgtatagtcaggattagcaagtttcagctttccgtcttcaatgacgaccgcatcacctgtgatcattgttttttcggcaggcagataaagactgatatggccgggtgtatgacccggcgtggctacaacgcgaatgcctccgcaccaaggcagcagctcaccgtcagtaactgtccggtgaactggagccgattcgactgattgaagcgagcaaatgaactgttttgcataaggctttgcatcctctggcaatgaactaaacgttgattcagcctgctcaagccgtaaagattttttagagccgtcaatatacggcgcttcacgctcatgtactgtcacgctgatatccgggtgcaaacgatgtaatgcagcgagtgagccgatatggtctatgtcgtgatgcgttacaatgatttttgtcaatgaatgaagcgacattccatgccgggcagcagcatgttgaagatggtttgtaaaaccgggatatccgcagtctattaatatcgtgtcatgttcgtcttgcagaagaaccggagtgatagaatgcaattcttcattatattcaaattcgatctcaagcggataacagcttttcatataaattctccccttcgctcaataaaaaagtacactgcttgtaagggcagtgtactttttgtctgtttcaaattatccttccagcagcagctgttccggatcttcaagcaggtttttaatggtgacaaggaacccgaccgcttctttaccatctacaattctgtgatcatatgataaagcgatgtacatcatcggacggttttcagagcgctccgcatcaattgctactgggcgcagctgaattttgtgcatacctaagatcccgacctgagggctgtttaggatcggtgttgacataagcgatccgaatgtacctccgtttgtgatcgtgaaggagcctccttgcagctcacctaatgttaatttattgtttcgcgctttcttcgcaagttcgccgatctctctttcaatgccggcaaacgtcaggcggtcagcgtcacgtacgactgggacgacaagcccttcttcagccgcgacagcgataccgatgtcatagaattttttcacgatcagctcatcgccttgaatttcagcgttaaggagcgggaattttttcaatgcagccacgacggcttttgtaaagaacgacatgaaaccgagttttacatcgttttgctcaaggaattggtctttacggcgttttcttagattcataacggccgtcatgtcaacttcgttaaatgtagtcagcatcgcagaagtctgctgcacttcaaccaatcgtttcgcgatcgtctgtctgcggcgggacattttttgcacttcgacaggtttgtcaaagctttgctgtgttttttgagcctgctgtttcggctgtgccgcaggttttgaagccggtttttcataagcttccacatcttgtttgcgcacgcggccgagcgggtcccccgtcggaatttgtgatagatcaatccctttttcccttgccagcttgcgtgcagccggagacgctaccgttctggatttcgcttctgattgtgcttcctggctgacttcttgtgcagcaggttcagcttttgcttcctctttcgtttgttcattggctggagcactttctgaaggggcgggtgcagaactttcgccagcgccttctgtaatggtaccgataatttctcctacttggacggtatcacccgaatctttcaatacctcttttagaacacccgattcttctgctgtcaattcaacatttactttgtccgtctccagttcaagcaagtactcaccctgttctacataatcaccgggctgctttaaccattgggctatcgttccttctgagattgattctgctaattcaggtaccttaatttccgccatttttacatttcccccttagtttttgcgagtcaagctatcagatacaatgcgttcctgttcttttttgtggactgtcggatctccttctgcgggactggatcgtcttcttcggccgatgtattggacatttactccttttggcgcaatttccgtcagatacgggctgatataactccatgcccccatgttctgcggttcttcctgaacccaaacgatctcttgcaggttcggcagtttggcgaaaagctccttcgtatcttttgccgggaacggatacagctgttcgattctggcaatatgaagccaatccttatcgccttccattttgttgaagtgatcgctgatatcaattgacacttttccgcttgataatacgacgcgagtcactttttcgtaagcatgggaaagaccggactgctcatagacaggcttgaatcggctttcgctcagttcctgcacttcagataccgtattcgggttgcgcagcaagctcttcggcgtcatgatcacaagcgggcggatttcctcacgaagcagcattttcgcttgtcttcttaaaatgtggaaatactgagccgcacttgtcaggttggccactgtccagttgttttccgccgccagctgcaggaaccgctcgacgcggccgctggagtgttcagggccctgcccttcgtaaccgtgaggcagcagcatgaccagccctgatttttgtccccattttgcccgtcctgcagatatgaattgatcaaaatagacttgagccgcattggcaaagtccccgtactgcgcctcccacaacacaagcgtttcaggcgaatacacgttgtatccatattcaaagccgagaaccgatccttcagagagcgggctgttatgcaccgtaaatgaagaagcgcagtcgtctaagtgatggagagcaacaaattcttctcctgtttcgctgtcatgcagcacaaggtttctttgagcgaacgttccgcgctctgaatcctgcccggtcagccggatcggcgtgccgtctttcaaaatggaagcaaacgcaagcgattcagccaatgaccattcaactttacggtcatcatcaaacgcttttgcacgtctttccaggattcttttcagtttgccgaacacgttaaaggattccggccagttgataagttcgccattcagcttgcggagaacatcaaaatcaatggctgtgtcaacgtctggaaaaccgttggacaccggctccggcaattcaatttcccgtacggcgtcttcttttttggcgggcacctttttataggcgtcttcaattcgttttgtcactgccatttcgatgttttgcgctttttcctcgctgatcagtccttcacttacgagtttttccgcaaagatccgcttgacagtcgggtgttttctgacggcatcatacagcatcggctgtgtcgttgacggctcatccatttcattgtggccgtatcgtctgtacccgattaaatcgattaagaaatctttattgaaccgcttccggtattcaaccgcaaatttaacggctgacaggcatgcttccggatcatccgcgttgacgtgaacgatcggaatttcatagcccttcgccaaatcactggcatattttgtggatcgtgattcatcgctttcagttgtaaagccgatcatattattggcgatgatatgaatggccccgcccacctgatagcctttcagtgagcttaagttcagcgtctcggcgacaatgccttctcccgggaacgctgcgtcaccgtgaattaaaatggcgagcgattttgtttcgtcttgaaccgggtaccccttttgcgttcttgtttcctgtgccgcccgcgtgcttccttccacaatcggattgatgaattccaagtggctcgggttatttgcaagcgtaatccgcgcgcttttggtttcagcatcctgaagctgtctgtctgcaccgaggtggtatttaacatcgcccgtccagccgtagctgatgccggtcgatccttcagacggcacaaggtctttattcggcgcgtgctggaattctgagaaaataatctcatacggtttgccgagcacatgcgcaagcacatttaaacggcctctgtgcgccatcccgatattgacattggttgtgcccgccttcacagactgggcgataatgtcgtcaagaaccggcacaagcgcgtctaatccctcaattgagaaacgcttctgaccgacgaatgtccggtgtaaaaattgttcaaatccttctacttccgtcagtctttctaaaacggctgacagtttttccggtgaatttttccggaacagttcgccggattcgaccatttttgtaatccatgcgcgctcttcgaaatcatgcacatggtcaaactcgaaagagatggttcttttataggtattgcgtaaatgctggatggcttctaagccgtttgttatattggcaggtgcgtctttacagatgacagacgcgggtattgctttcatttcttcttctgtaagcccgtactcggataacggaaagagctcgctctttttcggatcctttctgagcggattgacggaagcgttcagatggccataggttcgaatatcttctgcaagtttaactgctgctgcgatcttttgaatcagatctgcggtgacgcgtccctgttcctttgtttccgatgcctcttttatttggcttggcggagcgcctagttcgtcaaacatgtctttcagatccggatcaatgctgtctggatcttcagcatattggtcgtacagctccagtgcgtagccgaggttcggtccgtaaaaatcttcccaattcattctttgtttcatattattttgaaacatttgaatattacccccaacctagataatcaagtgatcaattcactatcttgaaataacttttgaacgctgtgcccaaaattatgtaataaaaacgcttccaaggatattttaccactgattgcgtttggattctaccttgattgttcacaaaatagtaaaaaaaacagatcaataccgaaaaaattaaatcattttaaaataaaaagcgaaaaagcataggaaaaagcctatcctatgcttttatgaagcagttttttcaaaagcggatacagcacatcgggcagctgatcgacatccggaacaaaaatactgtactttccgtacatatcctgaatggttttcatctgggattcttctatcgcagtattggacagaaaaacatttatgacttctatccctttttttctcgcttcgatgacagcctcgctcgtatcgacgatgccgttttgttcgtatccgaatgctgccggctctccgtctgaaaacacgattaaaaatttttgcgcctcactccgccgcatcagctgtttcgtcatttgtctgatggcgtatccgtctctgttatcttcttcaggcgcaagctgcatgatcagcggacccgcagcctgcagcagcgactcttcgaacggaatgacggtattgaagaaattcggctggctcgtttcggtcgcttcgtttgtatcctcccaaaatccgacgatttggtgagggacggacactgatttcaaggcttcatgaaaaagaacgatccctctttttgtttcatccattttgtcaaacatgctggccgaacaatcgacaagcaatgtaaaaacggcgtcaatgtctgaagacgggtcctgctttttatagaaaaggcgcgggttccgttccgtaaaatagcggatcagtttgcgattcagccggcctgcgtgaaggtcggtccgcgggagcgtttttttgtgctcaagtgttttttgtatcatctgcttcaggcgtttttgatatgattctatcgtttttgcctgttctttataagactgctcctcttcaggagacgctttttgaggcgtttgataaaccgggaaggcaaatttgttttcttttccgtcagccagcccggcgccctcatgttcatcctgaatggattcaagcgcttccagtttagagtaatcctctcttttcgtctgacgtgcggaaccttgaacggagccgagcgcctggtcaccgtcatcgccttctctggccgcgtctttcccaagatctgatttcgcgccgtgctcaatatcaaattgaaggaagctttttgacggcgcttcggtttcccggtgccacgtattcattttctcttcaaggatttcttcatctccgtcggaagactcagggagcgtgagatcgtcacttaacgaaggcgctttttttacgctttcgaataaaggctcttcagccgctttttcgtaatcaagttccggcagaaaaaagtatgtgttcagcatatctttctcaagcacttcatcaaggccttccatgaggtcttccgttattgttgcgatttgttccgtagaatccgcctcatacacccggatgagctgacgttcaatatacggtatcatcatatcaatattttcatgcatggaaggaatgccttcaagcggagactcagccgtcagcttgacaaacatcgcgcaatacaaagcgtcggtgaaaatgctccgttctaaattcaatgtcagctgcgtcgtgaaatatttcctgtacatctccctccgcttctgaaaaacacgtttcgttcccggccgttcttttttgatctgctcttcaattctgatatcctcaagcagcataaacagctgcttggcaaagctttggcgggtgaagtgccggtgaacgtcatttaaaaaccccgcaaatacccgaaatgagctgctgcgtgttccgacagcgcgcaaatagacatcgcttttcaggccggcttccatatccccggctgatcggtctttccaaaagtggctcatgtaaattttcttttcaaagggattgtagtaagactgcacgccgtattccacttcaacttcactgcttctggtcagtgttttggccagatcagtcagcatcatgaacaaaaacgaatcaatcgtgctgtcgttaaatttgataaacttcattgtatatccctcattcgaacagcgtttctgcaatatttctgacagcggctttttccctgtcgtcgtcaagtttttccacgatgcctctttcaatcgcccgtttcggcgggatgtacgcagccaagtcgcacgtatctatgagagccctgatggacgccgcttcttctgacacttgtccgttatgcgcttgtgcgattaaatcagaagacagcgtcataaagcgctcaattaatttctcatcttttaagacagactgagaggtcagcacctgtttcaggaggcttcctttaatatacggaacatcaatgatgacaaaacggtttttaagggcttcgttcagcggaacggtgccgacgtagccttcattaatcgcggcgataacaccgaatccttcgcttgccttaatcacttctcctgtaaagggatttgtcatcatttttctgtaatcaagcacgccgtttagaatcggaagggtttcaggctttgccatattgatttcatcaatgtataaaaaatgtccctcgttcattgcggttgttacaggtccgggaacgaattcaattgtcgcctgcccctgttcattttcaatcgttttatagccgacaagcgcttctgcatcgaggtctacggagcagttgacgctgtgcatcggtttatgaaaatagttcgaaagcgtttccgccaattttgtttttcccgaacccgtcggtccttttaataagatattttttcccattgtcaaagcgatgacggcatcgaatacaatcgctttatcttcggcctcatagcctgatgatccgattaaatcccggaattcttgggaaacgggatgattttgataagcctgcagtttgttttgtatatcttccggaagtgataggtgctgtaattctgaagtcataggtgatgtttcctttccatttgtattccataaccgagtatactaaaaaagcccttgtatactcaatacaaaagggctcattccctgcgggcgctttttgtcaggggagcgcaggcgattctggctccggaatttccgctcgggtttgttaaataatcgtccgtatgttcatgaatgacgaacgcgcttccgtcccggtcgagcaggctgagtctgctcccttcttttaatgaagtttgcggcgcgttcataatgacatccactttaccgtcagcccccacttcaagattggggagatctccggcgtgatgacccatcggattgttgaagccgtgttctttgttcaaagggttgaacggaccgccggctgattcgaaatcaggtgcctgacatgtccctttttcataaatatgaaatccgagagaagcgccgggcggcagatgtcccgctgatatatgaatgtctgatccttcatcatcagattccctcacttcgatatatccgatcgtttttccgttttgattgatgagtccggcatgctcacggtatgcagatgcttccaatgcgcggctttccccatgttttttgggcggagcaggagcgggtctcgccccgcagccgcaaagcgtaattgatgcgagcatgagaaaaagcaagagacgattcatgcttcctcccccttatttttttacccatcagtcttgtcaaaacgtgaaaatggtaaacaaaaaaagccccgaaaggcttttttttaaaaataactgcgcgctcctaaataagcttttttccaatatggattgcttaagtttgaaatttcaaccccggaggagcttgcgtgaataaaatctcctccgcctaaatacattcccatatgagaagggcccgctttatatgtcgtaaagaagacaaagtcgcctgctgacggctggctgatatgtttcatcgtattccaatatccggccgtgctcagacgggaaacagagcttaccttatttaaaaggtaatagatgtaaccgctgcaatcgaagcccgcaggcgtattgcctccccagcggtaaggcacgccgacatgttttttcgcctcgcctatcattctgtcaatctttgaccctgtcaccggaggttcgggagtatttggcttgtttggctttgccggtttgttacccggctgccgcacaggatcttctgtttttcccgttccgttaatcaacagaacctgtccgatttgaagcacatcagttgtcagtttatttttttctctgatgagctgagcggtgatgccgaaccgattagcaattttccagagggaatcgcctgcttttactttgtaagtggatggcttctcagaagggtttgaatgagatggcggtgttgtgccgctgtttccgttatgtgaagaacctttgatctttaatacttgattcggatacagcatgtctgatgttaattgattcagctttttcagttcggcgatggtgatgccggtttgattggcgattttccacagcgagtcacccggcttcacagtgtaagtccctgatgcgcctttatcaggctttgtctgtctgccgcctccgtccgtgccgccggcagaccctttaattttcagtttttggcccggatagatgatatctgaactcaaacggttcaggcttctcagttcagaaacgctcattcggtattttttagcgatcacccataatgagtctccgtatgtaactgtgtaagcaccagtgtttcgttttcctttttgccccgttttatgtgtgccgctcccgtcgggaatgtgcagccgctgtcctgggtggagtatcgttgatttcagtttattttccgcctgcagggctgaaatacttgtatgatattgccgggaaagcttccaaagagagtcgccgctttttacttgaatggtttttgcttcagcgggatgcacggcgaaggttgaagtcattactgcagatacagccagtccggctgcgatttttttcttcatataacgaaaaacctcctatttatcattgctgaaagggacgttccttttctttggacgccgcctgttatgcaggattcattcagaagtcgacattaattccgattcatttggtcttagatcatcaccaatgccacacattttacataaattgagaacatttcacaaaagactttggaatcattttcataacatggcttttttccgcgacattccacctttcttgtctgtttttcatacaattctcttcacggcgtgaaaatcctcccgaaaaacaaacaaaaaaaagcccgcttcctataaaggaagcgggtgacggctgattacagaacccgggtctcggcagttttcacgtcttctgctatcaattccgctgcacgctgtgctccgccggccgctttcagggattctccgatttcagaagcttttgtctgatattcaggattttcgctcaattcttttattgcttcagtgagcagttccgctgttacatcttcttttttaaacatcttgcccgcgcccgtgttttccacttggcttccgacggcgaactgatctgctcccatcggaatgacgatcatcggggttttgtagtaaagcccttcgctcgtactgttcattccgccgtgagtgataaataagtccgctctcttcaggatctcaagctgcggaacataaggctttacaataacattctcaggaatttcatcaagctccgccggatcaagatgtttgccgattgacatgacggcttttccgttaaagttcctgaccgcttttaagcatttattaaacaattccttctgattgttaaaaatcgtgcccattgaaataaacaggactttttctccttcaagctggtcaaacgggaaatcctgagccgccggcctttcagttatggacggaccgacaaagagataagaatcgccaaactcttcttctttcggctgaaacgctcttgaagtaaatacgatggtttttctgccgtcatttgagaaaatatcatacggcgttttaatgtctgcgctgaattcttcattaagccggctgaccgcttcggtataagccggataatgagatgattcctctgatataaggtttgtatttgaaaacacttctttaataaatgcttcattcattgcaaatgttgtgcaaagtgaatatgccggcagtttcagcttatttctcacaagccttcctgccagaaaatgatgatcataaaggatgtagtcgtatgattcatcttttacttcctcaagaatacggagtgcggctttttcggaagtctcaatcattaacagtaaaaactcggtagcatcccgctgttcatcacccgttgcgttttttccgaattcatcttttcggaaatcttcacattcacggaattccgctccgcttgacgcgattttgtgctcatattccttcacgccgtaatatacgacatgttccccttttgccttcagttcttttacgacgcctaaagacggattgatatggccttctcccggaaagccgatcatcaatacatttgccatctttccactccctattcttttaaattttatgtatatttaaacgataacaccaatacagaaaaaggtaaagatgttcaccttattaatattaaatgggtacaatattcccattttcttattatttcgtatgaagcgcccgcggcgaaacaagcggatacagtccgccgtctttagcaaaagacatttttcccgtttcttctgaaacaacgagcacgagtgcatcagtcacggccgaaagtcccatcgcggccctgtggcgcgtcccgtatttgagatcgacatgttttgttgtgagcggaagcacattggctgctgatacaacccggttttctctgaccaatacggctccgtcatgaagcggattgccgggataaaaaatactctcaattaaagctgaactgatctcggcatgcaggctggtccctttttgtatcattccgtccagcggatctgcacgttcaatcacaatcagcgctccgtgcttttcttccgccagatgctgcacggccctcgccagctctgtataggaaggcgtaaaatgttcgatatatgactgcaggtaaaacgacgaagcgacagcctgcatttcctgaaacgtatgtcccagttcatctaattcgcaaagaaggcattggtctttttcatccaatgtccgcagtatcattccggcatcctcggtaatttgtttcaagtacgtttgaacggcagcggtaaacgcgctttccgtcatttgagtgtggcgcatgtcacatcatctcctttcccttattttctgcatcgcgcgcatggatatgcgccgctgtgtacaccataatcatgaaaggaggcgaaatcatatggaatttgcacggctgatgcaatatatctgcacctttttaggggtcatttcactttcattcatttatgccaagatgtttaaaaagccgaaaccggataaaaaagagtaggccggctttcattgctttttatacataaaatgttataatttctctcgttaaaataaagaaacggggaacctaaattgagagaaacgaacacgatcggccaaaaggtcagacagctgttacatatcttcattccgattttaatcacacaggcgggccttgccctgatcacctttttggacacggtgatgtcagggaaagtgagcgccgccgatttagccggtgttgcaatcggttcaagcctgtggacgccggtgtatacgggccttgcaggaatattaatggccgttacgcccgttgtttcgcagctgtttggagccggcagacaaaaggaagtgccgttttccgtcatccaggccgtttatgtagcggccattctcagtgcggcggttatcctggtcggctttttcaccgttgatatgatcttgggacatttgggcctggaacctcgtgtccggacgatcgccaaacactttttaggctttttatccctcggtatttttcctttgtttgtgtacgccgttttgcgctcgttcattgacgcactcggcaaaacgcgagtcacgatgcttattacgctttgctcattgcctattaattttgttttaaattatgtatttattttcgggaaattcaacatgccggcattgggcggagtcggtgcggggctcgcttccgccctgacttactggtgtatttgcgccgtcagcttttttatcgtcttcagatttgagccgtttgccgggtactctgtatttcggaaactgtaccgtttttctccgtctgaatgcagaaaacttttgaaaatcggtttgcctatcggttttgcggtattttttgaaacgagcatttttgcggctgtcacacttctaatgagccatttccggacggtgacgattgcatcccaccaggcggcaatgaattttgcttccctcttgtatatgctgccgctcagcgtatccatggccatgacgattttagtcggctttgaagcaggcgcaaagcgttacagggatgcccggtcatacagctatatcggcattgtgatggccctttgtttttctttatgcacggcggctttcattttactgttcaggccgcaaatcgccggaatgtatacatcagatccggaggtgctcatgttgacgcagcactttttaatctatgcgctgtttttccagctttctgatgccgtagcagctccgatacaaggcgccctgagaggatataaggatgtcaactatacactcggtgcggcttttgtttcgtattggattatcgggcttccgctcggttacgcagtcggcacttacacgagcctcggggcatacggctactggatcgggttaattgcaggacttgccgcaggagctgtcggtttattcttcagactgatgaagctgcaaaagcgttatgtgaaaaaaatgatgattttataaaggaggagcagcaatgccgaaacataaactgctgtacgattatttaaccgaacgggcggaggatatcagtcagacatggtttgatacccttcatgatacggatcctgattctgtttatgcttctactgacccggctgttctcacaaatctgaaaaaacaaaatctggcgtttaattatcaactcaatcggattttttctgaagagaaggaagtatatacagcggcattggaaaagtgggcgtttgaagccgcacgggataaagaacatttaaaaactcccatccattacatcattcgcgagtttatcagagttcgtgatttgtatgtcggccatgtaaagcagtttaccagacttcattcagacaccgtgacagaagaagatgccgaagatatattccatacgctgattaaatcgtttgatgtggtcattcatattttcatagaggaaatgtataaaaacacaaacattcagcttgaagcgcaaaaagaattgattacagagctgagctcgccggtaattgtgctttttgacaatgtcggactgctgccgctgatcggggatattgacacggcaagagccaaaatgattttggagaatacgctgcaccagtgttcagagaagcgcatcacgcagctgtacattgatttatcaggcgtagccatgattgatacgatggttgcccaacagcttttcaccttaattgaatcactcggaatgctcggcgtgaaagcgacgttatccggaatccgtcctgaaatcgcccaaaccgcggtgcagctcggactgagtttttcaaatttatcaatacggtcttcgcttgcggaagcgatcgcttccgatctgacacaaaaaaagggataaggcatttcagccttatccctttttttatcagtctttccacggatatgtccaatacacttcttcttcaaaccatgtctgaagaaccggctcgttattttttaatttttcttccagctctctcagcatgccttccgtttgggtgcggtgcgcttttaaggcattcattttaatatcggcaacctctttaatatcaagaatgacatcaggcttgccgacggcttcctccctgttgcgggtgattgccatgcaaagcgtgcgcgggcggtcctcttttttctttctgtaaagcgctctgatgaccgcttcgccgcatgcatcatgatccggatggacgccgtgctccggatagaatgtgacaatcagactcggttttacatcgtcgataatctcttccatcatatccgcgagccactcgtcatcttcaaattcaagtgttttatcacgaagcccgagcattctcaggtcagtaatgtccattgctttgcatgcgtcaatcagctcttgctttcttaacagcggcagtgtttcacggttcgcgaaaaagggatctcccatgttccggcccatttcgccaagcgttgcgcatgcatacgtaacgggaatatctttttgtctgtgtaaagcaatcagtcctgccactccgtatgattcatcatcagggtgaggcaggatgacgagtacatgttctttcatgattttcacccttttctttaaactgtaaacggcttttcgctgatttgaagcgaaatcgccaattttccgcccggcagatgccccgccattaacaaacggtcttcttcatctactgtatactcagtcaaaccttctgcgtaaatccagccctcttctgttttcaaaccgacgcggtacgggccgtttcctttgattttcgcctgatggtacgtcacttttgcattgcgtatataggctacaaccgtcatatttttctcattcagatgcgctgaataagaaccggtcgttgtttccaaatggatatatacaggacgatcggcatatcgctctaaagaagtttgcacatcttcttttatgatcgctttcatagctgctcccctctttcttcttttaaaaattgcaaacgcttcgtatgtagttcaaccaattcatatttctcaatcggccgcagccgggaatctacaattcgctgcaccgccagagcaaacttttcctcgggtgacttccggagcctcggatgtgttctttgatcaagcagttcaagatcaatcgccttttccgcttcttcaagggttgaagccgggagagtgcggttattccacagtgcctgataggcttttgctatgtctttatcagtgcccattgtacagctcctttacatactcgtaatgattatacataatttaagctatcgctggaaagcgaaaggcttagcggctttttatcggccgcttccattttatctgtgaaaaggtaaacaaaagcaatgctgcccatatacaaatgaaggtaaacgctttttgcccggaaaacggttcatgatacacaaatacgccaagcataagggtgatggtcggcgctatatattgcaaaatgccgacttgatacagcggcagacgctttgccccctctgcaaacaataacagcggcagggccgtaaatacgcctgcgaaaaataggagcgcccatgttcctgcccccaaggacccaaaagtgctcccgtcagctgtatatcctaaataaataagtgcagccggggtaatcaaaagcgtctccagcgtcagtccgatcgtgctggacatgcgggttctttttttacataagccgtacagaccgaagctgaatgcaagcagcaatgcgatataaggaaccgcgccatattgaaacgcagatatgagcacggccgccccggcaatagaaacggctgctgtttgcatcttgttaagcttttcttttaagaataggatgcccaaaagaacggaaacgagcggattaatgtagtacccgagacttgcttcaagcaaaaagccgtgattgacggcccatatgtacacaaaccaattaacggaaattaaaacggaagcgaaaaaaagcgccagcaggcccccttccgatttcaaaagacgcagttcacgccatccggttttccacttcttaagcacagttaaaagcacacacatgaaaacaaatgaccataaaatccggtgagctaaaatgtccaatgcgggtatttgttcaagaagtttccaatagaccggaaacagcccccacatgacgaaagaacaagcggtataaatgattccttttcttacgttattcccttgcacggccttccccttcctttctgtaaacagattatattatatcacgggaagcttccggcgggcatatactatgttgtccgttaagaaagggtgagatgccgtgtttgattggaacagatattttcccttccaaaatcagttctctaaagaaacgtttaaaaatgctgatccgaaagatgtcgagacatatgtcaaccgagtgatggaaagcgtattcggcgccggttatgccggacagttcccttttcgcgacccgatgtccaaaaaggccgatccggtcgaagcggaaccgcccaagccggaaattgacctgtttgaaacatccgatcatgtttttgcgaaaattcccgccgaacaagaggaactcgaccgtatcaggattaagcatacgtcacacagcctcgttgtagagaacagcagcctgggagaaggaaaaaaagaaatcgtacttccgagcctcgtcaaacggaaaggaacaaaagcagtctataaagacgggatgattgaagttatgttttcaaaacaggaagactacaatctatcggaagtggagattttaagataaaaaaacggcccgcgcgatgcaggccgttttttcttaataaaatggcggataaccgccggctcccggcccgaaaccgccgtatgggacgcctccgtatccgtaaccggcaaacccgtacggatagcggggtcttgtaaaacctgtggcaatcacgcctccgagaagaccgcctaaaaatccgccgaataaaggagcgccgaacaaaaaaggacttctcgccggaaatccggcaggaccgaaattcccgcgatacaatgcatgacgagggtacatgtttttcctcctttatgtctgcctattcttaagcgtattcataaaatgaggaaattgattgggcgattgtaacaacatgtgcctctctttaatattgcattaatatgtaaacattttggttataatttgattatattttgattaactgttatactttttttacaagttacgatattataaaaccatcagggggaataaaatatgccattacttcgttttgacgttattgaaggccgggatgacgcagcattaaaaaagttactggataccgcccattacgccatggttaaagcttttgacgtcccagtaacggaccgttatcagatcgttcaccagcatcggcctcatgagcttatcattgaagataccgggctcggtttcaaaagaagcaaagctcttgtcatcatcagcattgtcagcaaagcgcgcaccgaacatcagaaagaaacgttatatcaactgatggctgatcagcttaaaacagaatgcggcatatcacccgaggacgtcatgatttccgttacagaaaacgggaacgccgattggagcttcgggctcggtgaggctcagtttttaaccgggaaactgtaaaaggcctccctgcttgttttggatgttttcaaactgaataaaagagggatggatgttggttagtgagttgtatccttgtttgatatgcggatttaaaggattagagacaagtcccgtttataacggcgaatatcaaaaaacatttgatatctgcccttgctgcgggtttgaattcggctacagtgaggaccatgacgtaagcttagggtttattgtaacgcctgatcatttaattgaagcggcatttcagttataccggaaacagtggattgagggaggaatggaactattttctccagatgatgttccggcggaatgtaaaaatgatcatttccttacattcgatgctttattaaatcaattaaaaggcttgaacctcaatctgaacaattttgatattaatggtttttatgacgattaaacattatcattaagaaaaggctgccttgggcagcctttattattcatcacatgtgtcgttggcagatcccccgggctcgcaaaaactgtctgcccatttttgcatttcctgaaaaacggcttgcagtgccatgcctttatcagtcagtttataaatgactttgacaggtgtttctggcagcacctgacgctcgacgatttcattttgttccagctctttgagccgctccgcgagcattttttgactgattgtcggtatcgtttcggtcatatctttaaatcgtttcggcccgtccatcagtacatggataatgaggccgttccagcgttttcccaaaagagaaaaagcggattccattttaggacacattgtatatcccacgtgaattcatcccttcatctatgaattgacaagttttttgtgatccattaaaattagttttcaagttacatttagtaagcttctaacttttctattatgataacacgtttatccgaaggaggaaacatgatgacatccgtattagacgttttaaaggaacgcgcatctgttaaagaatacgataaagacgcggtcattacaaaagaggaattgacagaactccttgaaatcacaacgcaagcgccttccgcctggaaccttcagcattggcattttcaagtttttcacagtgatgaagcaaaagctgccctgcttccggttgcttttaatcaaaaacagattattgattcatcagcagttattgccgtattaggcgacttaaaagcaaatgaaaatggtgaagacgtttatgctgaactggctgagcaaggcaatatcacagaagagattaaacaaacgcttttaggccagattaacggtgcataccaaaatgatcagtttgcccgcgattcagcatttttaaacgcttctttagcagcgatgcagctgatgcttgccgctaaagcaaaaggctacgacacttgcgcgatcggcggattcaataaagagcaattcgttaaagaattcgacgtgagcgagcgtttcgtgcccgtcatgctgatttcaatcggtaaagccgttaagccggcgcataaaagcaaccggctgcctgtatctaaagtgtcaacttggctgtaagatgaaagaaacccttagtccgcttaagcagactaagggttttttataggaatcgctcactgtaccaggctcgtgcctgctcggcttcctgctgtgtgagctgatgaccgccctcctgccattcaagagcaacggatgcatgagcatctgtcagatactgataaagctcctccgattcttcttttgtacataggggatcgcgttttcccgcaccgataaacacaggcagcccttccatatcaggcagcttcactccgcgtatcggcaccatcggatgatgcagaaccgctcctttcagtacatctttataatgaaacaaaagacttgctgcaatattggcgccgtttgaatagccggcagcaatcacgttttctctgctgaacccgtacatttgcgccgcttcatcaataaaattctttaattcttccgtccgttcaattaaatctttctcgtcaaataccccttctttcagccgcttaaaaaaacggggcatgccgttttccgacactgatcctctgacccccagcagacttgcgttcggatcgataaaacgtccgagcgacagaagatcatgttcatttcctcccgttccgtgcaaaagcagcagaacattttctgacgttccctgttcaaacacatgtttcatcatcattctcctttctccattatgggcagaacagctgtaatctgactgcgatgctcttccagccattccggaagcttcagctctgttccgagattttcaaaggattcatccgtcataaagcccggttcgtcagttgccatttcaaataaaatgccgccgctttctctgaaatagattgaagtaaagtatgacctgtcaagaatgtcagatgaagcaagatgagaatcagcaagaatatccttccactccgcctgctctttttcgctcgtgcggaaagcgacatgatgaactgtcccgtaaccgccggcacctgcttctttcggcgcaaggtcaacatctataatatgtccgatccttgcctccgattgcagcctgacaatttgattttcttctcctgtctttgaataaccgaagcgttctatgagaaattgaatggttgcttcaggacggtacgagtacagaagaacacctctcatgcctgtgatcgcttctttttcagtaatgcccgaaggagtccattcactctgtccgcttctttcatcttccattatggcaagcggcaggtcttctgtatcattaaagagaaggacttgttcagacagcatgatctgttcttttacagacaagccgttttcttcaagccggcgcttccaaaacgcgagtgctcctttcggcacggagaaataaattcttccggcctgcccttttcccacggttcccgggcggcttccctgaaaaggaaaaaatgtaatgatcgtgcccggctctccgttttggttgccgaaataaaagtgataagtggccgggtcgtcaaaattaacggtttttttaacgagccgcaaacccagcacttcagtataaaaccgaagattttcagcaggatcttttgcaaatgcggtaacatggtgcaatccttgtgtattcaatgtattcactcctaaatatcttgatttcgagatattaactattctaatttaatatgaatgaagatgcaactaaagtgtttcagttaaaaaagtaatagaattcttttttttctgaaaaatatcttgtgatcttatctgacacctgctatgataaggagcattatcaagtttcaggaggaaagtaaatggtcagaaaagcactaattttcgttctcatcttaatccctttcagccagctggccctgctgtcagtcgctaatcgggttcatccgatcattatcgggctgcccttttttcatttctggctgcttttatggatcgcagtcactccattatgttcgtttcttatttataggctgcagaagaaacaaggaggactggactgatgcccgcaaatataacagcattgatcattacagccgtcatcgttttaaccgttgtctgtatcggctttatagccggaagagacaaatcatcacgtacttctgttgaggaatggtctgtcggcggcagacggttcggggggctcctcgtctggtttttagtcggcgcggatctctatacggcttatacgtttttaggcttaacaagcacagcctacacagggggaagcgttgctttttttgcaatcccgtattctgttttggcgtattttatcgcttatttctttctgccgaaattgtggaaagtggcaaaaattcacaaattaacgacgcttgccgattatgcccgtgagcgttttgacagtaaacttttggccagtcttgtcgccattgtcggcgttcttatgctcattccttatatttgtctccagctgagcgggattcaagatacgcttcaggtggccggaacgggtgtcattaatgtcaatatggtcgtcatcatctcttttattcttgtagcgctgtatacttttttcagcggaattaaagggccgacgtttacggcgattattaaagacattctggtgtgggtgattatgctgtttatggtcgtctcactcccgctgatccattttcacggctggacgccgatgattcacactttggctgaaaaagcgccgcaaatgctgacgataccggactcggggccgaaaggaattccttggtttatcacagcttccatcgtatctgcgctggcgctctttatgtgggcgcatgcggcaaccggtgtatttacggcaaaaagcgcagatgccgtccgcaaaaacagcatgtttctgccgctttataatattgttttgattcttgttatttttctcggctttatcgcgtttcttgtccttccggaagataccaatccgcggctcgctttattgaagctgattcaaacgtcttacggcggagtcgcacagggatttgcttactccacgatcgcccttgcgtcattgattccctgctctatcatggccatcggagcatcaaacttatttgcgaataacttatatcgggatttgattcacccgaatgtgtcaccaagcaagctgacgatgatcacccgttcaatggtatttgtcgtcatcgggctcgcgcttttattcggtatgctgttcccgactgcgctcgttacccttcagcttctcggtgtttccggcatggttcagatctttccggctatcgccgtcagtctgttttggaagaatcaaacgaaagaagcgacaattatcggtcttctcgtcggtcttatcgtgacattcacggtaaatatcacccaatccgcccacggtatatatgaagggttttgggggttgaccgctaacatggctgccgttattatccttaacccgttttttgtaaaaaaagcgtcttcaaacgccgtcaaagacggtttattcaataaagcgccctctgataaactgaaccaaaaaggcgcttaacagaaaaaagccggcacatcgatgtgccggcttttttactttttgtgctgccatttgtaggtggcgacggttttagccgggatgacggcttcaaactgccgattttctgaaacgacatggaatttttgttctgaagatgtctggttgattacgactgtcacaatggattgatcaggattaaggaacgatacattcgagactgtgtttttggagccgtaattactttctatccgtttggctccgcgctcgataaattttgaaaagttgcctgtcatatgaaagatcgggatattccaatagcggtcagggtttttagcatcctgaataaacagcgtcgggtccggggtgcctatccaatgatgcgtcttaatttgactgtcgagcatcgtcacccacgcattgtagctcgacgcgccgttgcggaaatactgtgcgatccgatccgcccctgccgtcccccagacagaccgctccgttaagtgaatagattgatcaggatatctctttccgatttccgacatgacggaaaggtcaccgtcataatcgtgaaaagcgatgccgtctgccgcccggtttccttttttatcatctaaaatcggcggaatatagttccacgccccgctcgcattgtgatcataaatccaaattttcgtgtcaattatgtgttttttcaattcttttttcacggctatcgccagtttgcgctcctgagacggcggcatgtacatgctcggatagtcgatttccagcaaaggttcattttgaagggtcatcgcataaatcggaattccctgcttttcgtacgcctcaataaatttgcggaagtaaacggccagtgcgccgatatatttatctttcagctttccccgcttgaggttttcattcgttttcatccaagccggcgggctccacggtgaggcaatgattttcagttccggatttatcgccagcgcttccttgatggttgctgtaatgtgtaaatcaatatccttttggatcgagaaatgacggagcttaggatctgtttggccttcaggcatatcgtcatacgtataaaattcctgtgccgtaaaatcagatgtcccgatcgttatgcgcataacgtccatgccgataccatctttgggatcaaccagttttttcagcacttcttttctttttgcgggtgtcatttttgataaattatggattgtggattcttccagggacgatcctacgcccaacacactttgatagcggcgcgacggatcaatatacacggcggcggagtcagaagccttcttttttgtccatgtaagcggtgtttgttcgtctaaggcgtatttcacttccagcggcccgtcataccacgtacgggaagccggatctttttcagaactgaaccacacccttactttgtttttgtctgaagccttccgatcagccgcatacacttcggcttccgtgctgcttgatatgaaaaagaaaaacataagaaaaaccagggtcatgtgcagactttttttaaaaaacatgaaccaccatccctttccttatttttataagcgattctaaatgaaaagccggacagtcacctccttcccgttttaatgaatgcgctttcataattactgataaaaagccggcttcacacaacggtgaagccttccctttttacacctttaggatacatatgcgccgtttgtttcaatcacttttttataccattcaaatgagtctttcttaagccgcttcattgaaccgttgccttcattatcccgatcaacataaatcatgccgtagcgttttttcatttctccggttgtaaatgacacaatatcaataattccccatggtgtatagcccattacatccacgccatcatatgtgactgctttttccaaagcttttatatgtgacgataaatattcaattcttgaagcgtcatgaattgaaccgtcctcttctaatgtgtcaatggcgccgaatccgttttccacgataaataatggaatctggtagcggtcgtataagcggtttaatgtgtaccgtaaaccggtcgggtcaatcgcccagccccaatcactcgctgtaatataaggattttccacgccgtttggcaatcctccgtttaccacatccccggtattatcgtttatcacgtcactttttacggtagtggacatgtaatagctgaatccgaggtagtccactcggccatttttcaaaatctcttcatcaccgtcttcaaagtgtatctgatagccttctctttcaaattcttttaacgcatagcttggataatatccgcgaacctggacgtccgggaagaaaaagcgctgtctcatcgtttcttcagccagcatcacatcatcggggtgagatgagtacgggtaaatcgggacatgtgataccatcgcgccgatcctgaactcaggattgatttctcttcccttcgaaacagccaatgcgcttgccagcagttcgtgatggccggcctgatacatgacttcttttgcgttttcgttttctttaacggcgacgcccgagttcgtccataaaaagatcggattattcacatccatcttattattgatttcattaaacgtcatccaatatttcaccttatgtttatagcgttcaaaacacacttcagcgaatttcacaaaaaatccgactgtttttctgtttctgaaaccgccgtattccctcgccaaatgcagcggcatctcaaaatgtgacaaggtaattaccggttcaatcccatgtttcagcaattcatcaaacacccggtcgtaaaaagccaacccttcctcattgggctccgcttcatcacctttaggaaaaattctgctccagccgatggacgttcttaaacatttcaggcccagctcgctgaataatgcgatgtcctctttataacgatgataaaaatcgatcgcttcatgattcggataaaattcccgctcttcaattgtatctgttattttccggggcacaccatgcgcgcctgccgtcatgacgtccactacactcggccccttgccgcctttattccatcccccttcaaattggtgggcggccagagcgcctccccataaaaaatcttttggcaatgtccccatcgtttatatcctcctttatttgactgccgcttgcataccgaataaatgcactgcagcagcttcaagcaccgcttcgcaggtgtagaagaattcctgccttcattttcatattatacgtttacattataattgtaccggtataatttatcaatacataaacaattatagttaatttacgaaatggcttttaaaaacgattatgctataattctgaaagaagcgggacaataaatgaatgaggaatggatatgttaaaataccagcaaatcgcgatagatattgaaaaatacatagaagaacatcagctgcagcaaggggataaactgcctgtgctgcaaaccttaatgacccggtttaacgtgagcaaaagcacgataaccaagtccttagatttattagaaaaaaaggggattgtgtttcaagtgaggggaagcggcatttttgtcagacggaataaaagaaaagggtatatcagtctgctttctaatcagggatttaaagaatcacttgaagattttaatgtcacttccaaattattagcgctggaagtgagaaaacccacgcctgaggctgctcaaaatctgaatatgccgcctgacggcgacgtgtattatgtcaagcgaatccgatatattgacgggctgacattgtgtatcgaagagtcattttacaacaaatccattattacgtatttgaataaagagatcgtggcagaatccatatttgattatattagagacggtctcgggttaaagcgcggtttttcagatttatatctgtacgcggggatgttaaatgaggaagaagcggagtacttaggtctgtttacaggagcgcctaagctttgcgttgaaacgatttttcatttaaccaacggccagccgtttgatttctcaaaagtcacctatcactatgagcaatcacagtttttcattcaggcgaacagccacctttttgaacaggaaacgacataagacgggcttttcgcaaacaaaaaacaccccatgcgcgagcgacgcatcgggtgttttttactatttcatattcttatttaatgtttcaacggcttttttcatttgtgtatcgttgtccgcaagctgtttttgcagatccgtcatcagttttgccgttgtgtctcccgttaaaatacctgtttgtttcagcttctcttttgcttggaattgtttgactgcttgttcaaatgctttatcatacgtgccgtttacattcacgctgtaccccagcgctttcagcattttttgcgcattggtgacggtcgttccggaatccccgtatttgtatgtttttttcgcatctaaatacggcaggttcgcatattcaggaagcttaacctgatattgcggtttgatgccttttttatgaatccactctccgtccgctgtcagccattttgcgattgtcagtttaacggtagaaccgtcgctgtaatcttttgccgtctgcacggttccttttccgaacgttttctcgccgatcagcggaattccggatgattcatgcagcgcagccgacatgatttccgcggcgctcgcggtgccgtcattgacgaggacgactgtcggttttgtcactttgcgctctttcgtcgctttcatgacttctttcgtgccgtctttgtattcgacctgcatgatatttttccctttatcgataaacatgttgctcattttgatggcttcatccatcaggccgcccgggttgccccttaaatcgagaatgtatcctttcgctccttgtttttcgaggctgtcaatggctgaattcagctcttttgccgtcgattcggagaaggatgtgatttggatttcgccgatgtctccttttttcatttcagagtacaccgtttcaaccgggatggtgtcacgtttgatcgacaggttcagatcgccgacacccgctctgtgcagcacaagcttgacgtttgttccctttttgccgcggattaatgcgacggcttcgtttacattaaggcctttaacgcttttgccgttgaccttcaagatctggtcattcggtttaacccccgctttttccgcgggtgaccctttaatcggcgatacgatcaggatgctgccgtccttttcttccacttgtgcgccgatgccttcaaacgaagcggaaattgtttcttcaaacgactttccttcctgaggatccatataagaagaatacggatcatccagggaactgatcatgccttttatcgctccgtctactaatttgctgtcatctgttttttgatagtaatcacttttaatctgctcataggctttattgaatttctcaaatttgctgttcgtcaaagcagccgagccttgtccgaaaatggtcgtattgcccgtgataaacagcgtaagcgctgaggctgcgaccgcagtgatcaatataataaaaaacagtttaaattgccgcttcaagaaaacaccacctttttattcttacattattatcatagacgaacgctcattcgtcaacttcaaacgtgaggcgcccttctttcccgtttacccaaacctatgcttttctctcaacatatgctgaggaaaaaaggaggattcggcctttgagcaaatatttagaaatgctgtccttattcggagtcggaggggctcaccccggcgggctcgctttttccaaagccgttctcacaaaagcggctcctcctcctggcgaaccgattcttgacgccggctgcggaacgggacagacggccgcttatctcggccacctgctgtatcccgtcacctgtgtggataaggatccccttatgcttgaaaaagcagcaaaacgatttgccgctgaaggcttaaccattccgggctatttagcggagcttgagcggctgccgtttgctgaaaatcaattttccgccgttctttccgaatcagttctcaccttttcaaatcttgattcatcgctgtctgaaatcctgcgggtccttaaacccgggggcatgctgatcggcattgaagctgctttacaaaagcccatgccggaaaacgccatcacgcagataaaagacttctacggttttaccgtattgcaggatgaaaccgcatggaaacagagattgcttcagcaaggctttcagaaagcggatttcattcccgctgtctatgaaaacaatgcgcaggagccgactacagaaatggatttatcgcccgttattcagccggttcactacgatacgctgacggctcattacgagcttatgcagacgtaccgtgaatatatgggacactgcgcttttgtcgcttacaagtaaaacggcaattgtcctcctgttttcgtccaacctttttaccgcactctatcataagctgacatagaaagataggttggataggaggagaaaagatgcaaaactattatcatctttgccggcagcaccaaggaaaagtagcaagaattacagaacgaaacggcagagtccacgtcggaagaatcgtacgggtgactaacagcaaagtgtatatcacccctgtcggcggccgtcacagagggtacggattcggttattggggaggaggctggggaggctggggagcagcctacggtatcggccttggtttcattaccggatttgcgcttggaggtctgctcttctggtaataaagaaagcccgctttctatttttcaagcgggcttcttctcattacactttctttacttcattaaaatattcttcaagcgttaattgatggtcatggatggcttttgccgcttttttgcctacatagcgtaaatgccatggttcatactcatactttgtaacattttctttgcctttaggatagcggatgataaagccgtattcatacgcatggtctttcacccatttgccgtccgccgtgtttccgaacgcctcattcagctcatatccgttgcttttgctggaaatgtccatggcaagccccgtctggtgttcgctttgccccggatatgcgacggcttctttcgcctttttttcacctttcagactgacttcattatcgaaaataactttctgtctgtcataagaacggtatcctgaaacggcaaccaggtcataaccttcttttttcccggcgctgaatagttccgccaaagcatcggcggcaggtttgcggatatatcgtttctcgattttctcagtaaaagaaaattcgactttcgggattacgagatcattcggtttataatctcccggcagcgtatatgtcttatttacgagcgcaagtgtatttgtcgggttttgaatggtctcaagcccgttcacttctttaatatcattaaaatatttgctctctaatacaaaatcactgttttctgtcttcgttgtttttttgcttgatgtgtcatctgattgttttgtttcagctgctgtttttgtgtccttatggctgtcgccgtctgaaatgctgcagccggtgcccacgattgcggttacgctgagagcggcagcgagcgagaaccatttagtggatttcttcattttacccttacctttctttttttgaatcagggcgatgcataaagaagagggctgctttaatcagcataaccctcatctcaagtttacgatacagtatgcagcgccagtttaatcatatcatgaaaagtcgtttgacgctcttctgccgttgtttcttctcccgttaatacgtgatcgcttacagtcaggatagacagcgcttttttgccgtatttagcggcaagcgtatataaagcagtcgtttccatctctacgccgaggacgccgtatctggcaagcttttcgatttgggagtcttcattgtaaaactgatcggcggtgaatacgcttccgaccgctacgggaagattgtttttttgcgcttcctggtacgctttatgaagcagttcgaagtctgcgcaaggagcataatctacactgccgaaggcgacacggttcatctgtgaatccgttgaagacgtcatagccaaaatcacgtcacgcactttcacgtcattacggatggctccgcatgagccgactctgattaagttttgaacatcatagctttgaatcagttcattcacataaatagagatagacggaacacccatgccggtgccttgaactgatacttttttgccgttatatgtacccgtaaatccgtacattcctctgacttcattatagcattccacattttcaagatacgtttccgcaataaatttcgctcggagcggatctcccggcaaaagcactgtatccgcaatttggcctttttctgcgtttatatgtacactcatttccttttcctcctgcctattcaaactcccacccattgtacactgaataacggtaagagacaatcatcagcattgatcagggcaatcttgggcagaatatgcgggatgacaagcctaaagaaaaaggagtgaacataatgggcaaaaaacagcgcaaccgggtgaccggccagaaaaagaacaatcacgtgcccgtttcagacgtcattgcagctgatgaagcgcatggaaaagagcattccgccgctaaacggaagccttaacactgtctttcccagacaatacggaagccggctgaatcttcagccggctccgtcttacctcggctggacgagcagccggttaattttactccatcccgcagggttaagcctgtaataggtctttccttttcttccttcgtctatgagtatgacgtctccggtcgctatgaatctggcttgatagtcgtttgggaccgtatcaggcacattaaaaacagaaaatgccctttccagtgcgtcttgatgattgtcagcggccagctctgtccgatagacgaccctgtatccctttttctcgccgtagcggggtgtttgaaaaatcgtcacatcataggcacaagtcttttttttaaacacgggcagcgataacagcatcaagatccctccctcttatttcttaatagtattagcgttttttctcatttttcctgtctctatttttgtcgaaacggatgatacttttcgtcaaagagcgcaaaaagcgaaacgaggcaaagtccgagactgaatccggcaaggacatccgtcggaaaatgcgcgcccaaataaattctgctgaatccgatcagaatgacgagaactccggtaaagacggtgagggccctctttcttttcgtgaaaaacggaacatgcttgatcaaaaagtaagcgatgacgggatacatcactgccgaattcatggagtggccgctcggaaaactgtatgaggtttcatggacgagcggttcaaaagcgggtctggctctttcaatcaattcttttatttttatgtttacaatccgttcaatgagaaagagaagcggcaaaaaaacaacatccggcgtttttttgtacatatacagagctgcgcctgtcaaaagaagaagcggcaaaagcaccgcggtcgtgccgagctccgttatccataacatcaattcattcagccagacagacctgatcctgacagccgcttctatcacacgctcatcaaaagcccggacggcttctatccggatcgctgctgcgagcagaataaacaatgcgaaaagacttgctggcttgtacaacgttttccccccatgtttcattctcccgagctgattgaaaaaaccgaagctttttcacttcggttccgcagtttcagtcttcatcaagctcttcgtctatcatacatttttctaataaataatcaaaggtgatgtcggctatttcgaagatttcctcttcactcggtatgtacccgcgcatagcaagctgactgtaaaaataatcagctatttcttctgtgtcaatcacaagatctatttctttcatgcaaacaccgcctccttttttatgttttatgaaaaaaccgttcaaattatacccgaaagttctaaacgttttgtccgctcatatacttttaaaaaaacaagccccggagggagaaaagataatgacgaaaatgatggctttattggacggagatggatttgatatcgtattggaaaaagtgctgaaaggaatgtcgtttgtcatctttgccggctgtctgccctggtttttatatgtcaccgtccgtttttttgccggctagctgaaatgctcccgcaggctttccagcacaaaattcatcatatctttatattcttcgtcaccgaacaaatgataaagaatcttataatcgttataaatatcaagcagctcatctacaatcgataccgccagcacatgcagggcatcgggatcatcagcatcgccttcaaactgaagaagagcagacgcgacggtatcctcgccgatctcatgagatgcttccccaacatagtggacaaacagcagctgatgcacaaactgatccatttcatattttctcagaaccagcgtgagatcctcttcctccgtttcaagccactctccgtctttcagccgagtcagctcataaataatatcctcccagccatcctctaaatatctccatatttcagttctgtgaccgataactcggaataattcctttccgtagtcctttacatatacgacgtcgccgatcagaaattcatattcaatatctaatttttccatatcgacgatcacgccctcataatctttataaagctggatggacgattcaaaataaagcacttcattatgattgacttcataaagataatgtttatcaatttgatgaaccttcgtaatggtgccgacggttccgtacatcacgacgaccacgatgtctcccacttgaaatttcggtttatctggcttcatgctgtctcccccttgccgcggactgtcatacgctatcgtatgccggccgccataatttcgcatgggcatgaaaaccacaggaaatatctatttctgcacctgttcaaaatggcaaaaaccccaacatgcttgtgcgttttttcacttaccgtaacagaagcgtctgatggcattgcgctctcgatcgaatgagcagtaacaatgacgagacaaaaagcgcctgtttttgaatgagtttttgtttatttctccatgacacaaagataaatacccggcccgaaggcatgttgacaatatcaccgccgtgatgttcaaaatttgccgtgaaacacatcatcgaagatgtatggagatccaattccggctgcatatctgcaatggcttgtttatcatgaagaaccaaactcgtttcggctttcaatgaagccacaacttcaatccgcttcaaccttgtcacataaaattcccttttccgtccaaacgtcagtgcctcaccatagatcatttgattcctctcacttcatttaaatgtttgattatttctccgtgaaaagaggctccttacacgggaccccgccggcagcaggtctgatccggtgaactctgcagctatacattctgctgccttatgatccgtgccatcaggaagacttgtttacgcgctgatcaaaacgaaaggcattgcgggatttgatcatacggcacctcataagcgattgatttcaacagaaaaaaaccgcacaatgtgcggtttttcgtcaggcgtgatgcacctcggtctcatatttttcccaagcttcatcaaatgtcgccatcgtttctaaatagtcggcgctcagttctaaataagaactgagctcgtgataatcgcttgacgttttcggaaagccgtgatcttcgtatgcctgattcgcaaaccggctgattgcgtcctgcggtttgggatgcctgtatttcatcaaatagtgataaaaggatttcatgggtttcccctcctgatgactgtcttttgttgtactattatacaattcaagtgtgaaattacaacaaaagaagactaggagaagtcaaaataattccgtttcaagatccgttctgtccccatcagctcttgatatgtgagtgtttccggtaatttttttgcatcgactaaaaaaagctgattttcgatttccgctatgaccgcttcctcctgatacgtcatgccgcaggaggagcaggcgaatgcgggtgtttctgtaatttctatggctctcgtaccgtcaggaagctcccagtacacagccgcctgacaagctgacgccttctgattgccgcaccactcgcatggcttcacggcgactcacctccgacttccgatcctgctttttgctctttcttttgctgtgcaataaatttcttttctttcaattcatctctcttttccctgcggtctttcagcgtttcatgatcagggtttgatgtaaacgttttcctcctgtcgatcctcgatacattttccggtgtgaacgaaacctctttgtccgcgaaaatggcgctcagtccgacaggctcgcgtttggccattgttcccggaaaaacagattcaaaatagtcgtcagcttgattcgggatatagttttccggctcgggataagatgtaatcaccccttcgaagtttctgatcacaactttctccggactttgggagagcaagtagttcggctgcagggcgattttaccgcctccgcccggggcgtcgacgacaaaggtcggcacggcaaagcctgttgtgtggcctctcagtccttcaatgatttccaatccttttgacacaggcgctctgaaatggccgattccctctgacaaatcacattgataaatatagtacggacgcacgcggattttcactaaatcatgcatgagttttttcataatcggcaccgaatcgttaatgcctgctaaaataacagcctggttaccgaccggaacacctgcgttaacgagcttttcacacgccgcaaccgattcttccgtcagttcgatgctcgtattaaaatgagtgttcagccagaccggatgatattttttcaaaatctgacaaaggttatccgttatccgctgcggaaatacgacgggcgctctcgttccgatcctgataatttcaaggtggggaatgtcacgcaggtttttcaaaatatattccagaatctgatcgttaattaaaagcccgtctccgccggaaatcaggcagtcacggatttccggcgtttcccggatgtaagcgattgccgcatcgagctgttttttcggcacccccattccgatctgtccggaaaaacgccttctggtgcagtatcggcaatacatcgagcattgatttgtcaccagaaaaagaacgcggtcaggatagcggtgcgtaagaccgggaaccggtgaatcttcatcttcaaacagcggatcttcaaggtcatatttcgttttgtgcatttcttctgacagcggcacggactgcatgcggatcggacatctcgggttatcgggatccattaaagaagcataataaggcgtaatgttcaggggaatggtttttacagacatcctgacgccttcttcttcctcttcggtcaaatgaatgacttttttcaggtcatcgacggttcttacagtatgggtgagctgccacagccaatcattccacttttcttccggcacatctttccacaattcaatctccttccagtgacgcttcggctgaaaccatttgtttgtcaaacgaattcctccttatgaatggccaaacgtaaagttttgcaccatatattcatattttcgagcccttctgaaatgcggcagttgttcacaagcctgcctctgtagccgtatcccgcatgatacaaaacggcgttcatcccgtaagacgctgcacgggccaaggaaaaaagatgaatgattccccggccagcgagttcctgctccaacgctttaaacaagtgtgccgttacggagttccccctgtaatctgacagaaccgcgcaatcggtcatttctgcgtgccccaaaaccggattgatatctgcgcttgccgccccaatgagacgatcctgatcgaatgcggcataatagatggtgttttctttcattgtttttttaatataaaggggattaaaaacaggagtcggataggtaagaaaaacatgtttatataagtgcgttaaacggtccgcatcatcttcgtccgcttttctgaacatcagcgtgctttctgtctgagtcattccccgccgcggtgtctcatataaacggtcaacagccgaatcttctgatacatatgaatctgaccgtctccgttcctctgataaatagcgcaccatcacaacagccttatgcccgttgtaatacccgtctatggcaccctcaataataaaaagatgcttgacaaattccggctcatcgccgcgcttggcaaagaaaatcaccttttgggctccctcttcctttgcttctgccaaaacggccggtataagcgcctcgggctgtccgtcataacgaatgaccctgatccgctcgttgaaacggtctgcatcaatctcggccgctccgctttcagccctcagttcctttatcagcgctgtcacccccatctgccaccccgcaccattccatgataaaaagagaaatgattttgacggcatcgattaacgcccggacttcaatgtattcattcgcctgatgcgccgccttgacttctcccggaccgaagacgatgaccggcgtctgtcccgcgtgctgcaaaagccctccgtccgttccccacggggacgcttcacgaaccggttttgcccctttcattttctcaaaagaagattccagagcggaaatcagcggatgctcatccgggagatcattcggaagccactgagccccaaaccattctatttccgcggggtggtgtttaaaccattcatcccggtactccaaatctttcagccagcttgccagctcttcttttactgcttcgggcgtttcatccggcgctattccgcacctgccttctatcaccacacggtcagctaccgatgatggccacgttcccccttggacggtgccgatattaatgggaaccggaatcggaacgtcccgataaagcgggtctttgatacgggcgttacggacgtgttcaagctctttaagggctgtgatgacatgcaggcttttttcaatggcgctcaccccttcatagcgggtgccgccgtgtgcggacaatcctcttaccgtaatgcggaaccacatggacccttgctgcttaacaaacagctttaaattagtcggttcgggaataagcgccccgtcagccttgtagcccttcataacagccgccagtgttcccgcgccgccgcactcttcatctacgacactttgaaacagaacatctccttttaacgtaatcccgcaggcttcaagcgcttctaacgcaaacaagagggctgtattgccgcctttcatatccgttgaaccgcgtccgtaaactttgccgtccttttcaacagctgtaaacggttcatacgtccatgcggcgggatttccttccgggacaacatcaatatgtccgttcagtatcagtgatcttccgcccccggcccctttctttacggctgtgatattcgggctttcatggaagtcttcgcgttccgatacaaaataaggatgctctttcaattgtttgacactcggctcccagacatcaatatccatgtcaaactgtctcagtttttctaaaacgactgcctgtgcgttaaattcatggccgaacgtgcttttttccccgatcagccgtttcagcaggcttaccgcttttgctgtgttttcttccgcccactcagtgactttcttttctaattgatccatggacagacccccttttaagaaaacattctcccaatctgatttcggcatccgttgtttgaatgacatcgtctatggtcgtgccattcagcagttcctcaagaacaaaagccccatcatctatgctgatgacggctttctctgtaatgatgagatctgcacagcctgctgctgtaagcggcaatgaacagctttcgaccagcttcggccggcctttctgatcggtgtggctcatgacgacaaccacttttttcgcgccttgggcaagctccatcgccccgcccattccgggcacctttttccccggcacgagccaattggcgagatcacctgtcctgctgacttggagcgcgcctaaaatggtaatatctatcagcccttttctgatcatggcaaaagacagagctgaatcaaaataggaagcacccttaactgtactgacaggaaatccggccgcattgcataaaagctcatcctcctctccgcgctccggactaccgccgatcccgaggacgccgttttccgcctgcagcattacctccatgccggccggcagaaagttcggcactaaagaaggaatgccgatccccaggttgacaatcatacctgaggtaatttcactggcggcccgcctcgcgatactctctctttccgctattcccaagcccatctccacttcactccttcactttgcacgataccctccacgaaaacgcccggcgttacaatatgctcgctgtcaagttcgccggcaggcacaatttctgccgcctcagcaaatgttctttcggccgcagcagccatcagagggttcatgttgcgcgccgttttgtcaaacgtcagatttccgaattcatcagcaatatgtgccgacacaaaagcgaaatcagccgtcagcgctttttcaactaaataggactttccgtcaatcgttacggtttctttgttttcacaaacggttgcgttatcaatgccgatatcagttaaaataccgcctagccccgctccgcctgcgcgaatccgttcagcaagcgtcccttgcggcgaaaattccacctcaagcgctccgtcagtcatttgtctgcccgcgacaggatttgagccgatatgggaagcgatcagcctttttacccgcttatgaacgataagcggaccgatacctatttccggaaatccggcatcattgcagatgacggtcaattctttaacgccgctttccaaaatcgcttcgattaatgacggaggtgaacccactcccccaaaaccgccgaacatgatgacagattcgtccttgacatcggcaattgcttcatgaatatcgatttttttatgaaaaatagacatatcagctcaatccttcttcatcattttttcagcttcttctgcggactgggaaaatagatctgacagctcatccagctccgcatatgaaatcgtgaacggcggggcgatgatgacggcgtctccttctccgctgtcaataccgggctttgctgggtaaataagcaggccccgattttttgccgctttaatgattttttcggtgaaggcctgttttttcgaaaaaacgtccttcgtcgttttatccttaacgaattcaaccccgatcaggaggcctttaccgcggacatccccgatcaccccgctgcggtctttgatttcttctaatttccgcttcagcattacgcctttttcctctgactgccgaagcagctcgtgtttcttgacatagcgaagcacttcaagcgccgcccttgcacagtatgggttggcactgtacgtatgtccgctcataatgaccccggagccccgcttgatcgtttcaatgatgtcatcagacgcaacagctgccgcaatcggagcgtaaccggcgcccaacccttttccgagcaccgcgatatcaggggcaatcccccaatgctcagaagcaagcatccgccctgttctcccgagccccgtcatgacttcatccgcaataaacaaaataccgtgcctgcggcagacaacctcaagcgcttcataataacctgccggcggagtgatggccgccccggctgctccgacaatcggctctgcgacaaatcccgcgataaatgaggaaccgatccgctgaacagccgtttccagttcagccgccgcagctttcacaaattcctctccctgcagctctgaacgatacatattaggcgctgaaacggccggaaaccgttcaagcagctgggtgaagcggtatctccgttcatagaaccctgataatgaaagcgctcccaaagtaatgccgtggtaacttccccatcttgatagaaagacggatttttggtattgccctttttcctgccaatattgaacggccattttcatcgctgtttcgactgcctctgagccgctgtttacaaaaaatgaccaattcagcccgcccggcagatgatcggccagaaataaagccagttcttccgccggagtactggtgaattgcgagcgatacacaaacgaaacggagtcaagctgttcttttaaagcttgtataatatcctccgtgccgtggccgatattgcaagtgaccgcccccgatgctccgtcaagatacttgttcccctcctgatcatacacatatgatcccttaccatgactgactgacggataatttgcgtcaagctccggtttgattaaatagctccccatatctttccacctcgaaaacccatttgcttcattgtatgaacagatgaataaccgcattcttatccttcagaaagttttttgcagaaaatacctttctgtaaaacaggctgccggaaatgtcccgacagcctgaagagcgttctggaaattctattcctattgttgattttattctttcttcggttctgctatttatctgctcatcccatcatttttgatctgaatcagtataagcagaaggcggaaaattcccgtcttctttactgtatgggaatcaatatttcacacaaatgatgattcaccttttgtaaagtatacctttcgataataggctgttctctgattgataaattatttttttcgatctcagaaaaaacagtgttccaaaatccgctgactgcctcttttgtatgatcaagcaagaaaacggcgtacttccctccggaaaatgtaccgatccgggctggttcaggcacatggtcttgattgataacaagacaaacatcatagcggcatttctctttaggagtacgattcggatgatcttgcggaattcctaaaatgacagaataatcaagcagaccattcaattgcgcccagtttttaaatgactccatcagttctttgttttgctttccgccatactctccgacgtttcggaaataagcaattctggattctggtaattcttcaatcgtcatgttcacattttctcccccttctccagaaaggtaatatgtattaaaatgtttttcaagctgatttttcagcatggaaataacaaaaagcctgcagaaaatgatgttctctgcaggctgattttcattataggattttttcagtctaacaaataaaagccgcaccgacgatgattaataaaataaacaataccacgatcagcacaaaagtgctggttccgcctccgcagccgccgtgcccgtaaccatagccaaaactgccgcaaccgtagccatatccgtatccgtacatacgcaaatcatcctttcttcttacgatatacggcattgtatgcgggccaactcccaattggtttatgcgaatgcccaactatgtaagaaaataatgaaaaattgtatgcacgcgccgaaatcttttgaagccgagtttttcataaaagcggtttacaccgtccatcccggacgtcacaaggtatacggtttccatgccgttcagctttgccgccgccatcagctcattcatcaatatcgatccgtagccttttcgttggaattgatccagaattgcgacttcttctatttttgcggttttatctgctttgttgatgaaaagctctccgcagccgatcggaatcgtttgcgaggcgtcgctgtagcacacgacaagcataaccgttccctccttatacaaaggatatttccgctcaagcttttgttcggccgccgcctcgccaatgtaaagggcatcatagatgttcataatagacgacccatcggcgaggctcttttccgtcccccaagcagtgagcgggtgtccggcctgcaggtccccattttccagtttccttgcaaaaaacagctcatcttccactacgcagccctgctttaccaaagtttgtttcagaagaagcggaaatgcgtgctccggagacgctttcacatgaatataattggcttgaagcatgcccggaacggacgaaagaaacggcagcagtttgtctaacggaaatgtacggtgcagctgaacaaagttatgcgaaaaaatctgcggcaaaaaagggtccgtatatacactgaaatgctcgaacctctgaatgccggaagtaagctctatatactgcttctcggttttatcaaattgatcggtcataaaagctctccttttccttgcacatccgactgcatctctcaaccttttgttatattgagatttcttataatttcatcgtacaccggatagaacggcattccaattggtaattgtttaatttgctgaaaggaaatgggtatcgccttctgattcgcaaaaaatcgtttcgctacgtcatgactgatcggatggagaacccctctcaaataaacataaaatttccgttcaatgcgaaacagcatcctcccgggcaaatgttgaacacagtccgatgtccaccggctgatcggcggaccgtccggaagcgattgtatttcggcccgttctaaagccgggatgccatgccgtttaaatcggtaaaagcgaaatgcgctatgatcaaccagccttttctccccgtcttctataaaataaacatgaaactgatccctgacgagctgaaaattcggaatactggcggagtcctcttcctcatattgaaataaaaacggatccggaatgacgacggtccggccttcgtataacgtatgccagcgctcgtttacaggcttccttttatttcggtcaagctgatatactttctgatccgtcccctttacaaaggatccgtcgatcaggacagacggaagcgattgatacgtgttctgaaatgagtggggtgttttataggtcgtatccaacacttcttttatcggcagaaatgatgtaaatgtgttgagcctgctccaaaaaacagagtctccgtgattccaatgcataacatcttcgtcccaaaagctgccgaacttctctttcacacgctcaagcaatgatctccggtgcatcactgaacagtgatcaacgagaaaagcggcctgatcaagcacctcttcagcaaaacgatagaagtggaattgttctgttccgcgcccgtttacatgtatcaccttctggctggaatagacggcatcaaactcgctgcattgattaagcgcttccgccatgcggctgagcctattcggatgaaatacggtgtcgtctgtcaaataagtgatgtattcgccttcggcccgtgaaagcgcatcattaatcaaaacggcataccgggtcgacttcagccgttcggccggattgataaaactgttgtcataatatatgcgatgatcttttatatacgtactgatggcggccgaggtttcttcatttgaatgatcatccatcacaaacagctcccaattgctgtaggtctgatgcaaaacactttcaatcgcctgttttacaagatccggtttgttgtaactcgttaagataattgagatcttcttttccatcccatcaccccttctgtaaaacgtaaaaaacggctccgaaagagacagagcctgatatcgttattaaaaagccccccagctgacgatgcttgaaatcgcgacgtttgatctcgtattattgagcggattttgaaaaacggccaaatctgacagcacttctttgacaattacgttctgcagtgtgctgccgttaatcagattgacgcgcgacacaggaaccccaagctcttttgccattacaagctgacgccgcaaatctgaatgatctccggacggctgatgagataacaaaagaagaagaagcagtacgagctgaaattcctcctcaaaacccccgtgttttacagtttctcctgaatccaaaatattcctctccttcattttttaatctatacaacgtatgtcatactcttacaatccgcataggcaaacaaagcctgattcgaaaattcagctgtttgattaattattgaaaaaaatgcaagcaaaacggcattcgacttataccaatcttttcaatcaggaatatgaataaacgtgaggttgaaattgtaaaggaggtgtatgtccgcatgagcgaggatcgtttggagcttaaaaagaagttattaaaaactcttttagcccctgtatttgacaacagcgctttatctggcggcacagatggaggagataatgtggaaaacaaagtaaaagatttattggaatcggcaattgatgcaaaagtggatgaagcagcggcgaaagacagtctcagcgcacaatctgtattgggaagcggtatttcattagcggcgagatggatttttgcaagaattcagcccggcactgtcatcagcattgtgatggattcaggagacatgatcggcccggttcaatttgttgcctttgacgaaattcacggaatcgtttttgttacgcaggaaaattccgttacaccggcaggctctgctacaacattgcttgacgtcgacaaagttgaaagtgtcacgttcacttcgtaacagcatatgaacgttttatatatccgttcaggatataaaggcatatacacgtattttgaccgctggatcgaggaaggctttttacagtcttccgtccgctttttttctgtttctgagtttgaggaagataccatccgcagtatacgggcattcaaaccagacatcagtctgatgatgacgggagaccgtattccgtctgaatggcttcaatggctgaagacagaacagattcccgtatatctatggatgacggaggatcctttttatttcgatgtgagtatgacaatcgcgccgcttgcggatgccgttttaacgatagaacaaaacgcgcttgatgcttaccggcaaatgggcttacagcacgtatattatgtcccgatccccgttaatcagcggctttttaaaaaacaacctgctgaagcctctcttcacacaaatctgcttctgatcggatacccgtatccgaaccgcgttgaactggtgaaagcagcggcgaagcttccgtatacgcttcgtattatcgggaagggatggcgcagacatctgcctaaaaaaatcgccagacagcaaaatgtgctcgtaatggatgaatggattgaacccgaacttgccgcattatattacaacagcgcagaggtggtcttaaaccctcaccgttcttatcggtttgcgctcaatcagaacggacgcggcatcgaaaataccagtttaaatacgagaagcttagacattgcggcttgtcaggcctttcagctgacagacctttctcccgcgcccccgttttcaacatttgtttcttacagcgggtttgcggattttgcggataagatccatttttatatgacaaacccgggtgaacgtaaacaaatcgcggcgcttaattatcaagagacagtaccggcgtacacgtatgaccggctgccggctgtgcttacggctatccgttccaagactttctcatgaaacgctcttcacatcaaaaagcagcttggataagctgcttttttcatgtttattttccgcttctgtcagtcagttttctcgggtcaacctgtttattgacctgcggatgaaagccgattttatcagcgattctttcccatggcaccattttaaaattttgattggccttttggccgtgatctatattctctccgtcctgtgcgacaaaaaggccgaacggatactcaggccccagcccgaaacccagaacgtcaattccgtctgtatcgcttgtgccgtctgtttcaggcccgtctgttatctgaaagtccgcaacatatttgttctgtccctgtctttcataaatcgcgtagctgctgttaccctggcttgaggcaagcagataacctttcccgtcagcagcgtagtaaatcgtcagtccttcaatatcaggggttaaatgcctgccatcggcacgatcgataaccgttccgttactgccgccgtccggctcagcgctgaacttccagatggcctcatcttcttctgcgatataaagactgccgtattcatcgtctgctgccatcccttctgtctgagaattcattttaaacgcccttacctttttgccggatatgtatccatttttatccgcatttaattcgtattgttcaaattcgccttctttccctgtcaccatcgcgtaatattttcctgttttttgactgtggtacaagctgaaaccgtatacttcatcaattgctgatgcaatcgggcggtttggatccgtaatgctttgtaatgtgccgtttttcccgtcaatggcgtaaatctcaatggtattctttccttcagaccgattggatgccgccgcaatatcgactttttttccgttcaacggaaaatcataacggatatcaacattgttcagcttcccggtatgataggaatgaagcatctttccctctaggctgtacacgactaagcctgattttttattggttgtgatcaatttgctgttctgaggattcttggggtccagccaaatcgcaggatcatcagctgcatcaccggctgtatcaaccggctccgtttccgccgccgcattcacggtaaaatgataaggatcagacagcttatgtttggcctgggaagaaaccgcaccgcatgtgagcatcaatccggctgccgcggttaacaaaagtgtttttgaatgattcattttccatcctccttttatgaacgtgcactttaattgtaaaatacatacaggaagttcagtgttaagtttttgtgaagattgtccgaatgtgaggatttatgaagagaaaaaattgacgtgagcaaatatttaaaatgaatatttagtacaatgttttatttgtaatttctattctattaatcgggtaacgcgatatgaaagcgcatcagattaatgtttttctctaatttttgatttattggtttctttcattaactcgctgaaattgttcaacatatgatgcatggtagagaaacgagagttggaggataagccatgcctaaacagcaagcagtagagctacaaccgttttttcacgataaaactgttctcgtcacaggcggaacaggatcaatcggaagccaaatagtaaaacgccttttgctcttaacccctaaagaagtcattgtgttcagcaaagatgacagtaaacaatatgtgatgaagcaaaaatacgcggatgaacaaagactgtcgtttgtgctcggcgatgttcgtgactacagaagagtcaaccaagtgatgaaaggtgttgatattgtctttcacacagctgcgctgaagcaggttccgacatgtgaggataatccctttgaagccattcaaaccaaccttatcggcggacaaaatgtcgcagaagcggctttgctgcaagaagtgacgcatgtgattaatatcagtactgataaagccgtttattaagatacttaccacaaacaaatcaaaaaaagaagcttactctgcactcctttccaaagcagcctccaataaatgctgagcaaattgtttataaaattcatctaagtcattactcgcttcatcctgatctatatagcggatactgtaattatctttatggacaacctttattgtttttttctttaattcctcataacgttggtaaggttccaaaactacacccccgctttcacaggagtattatatgtatgtaatggttcgtctcttgactgttctttctttatcaaagcctcgcaagcttgttcaaatgtatgatccagcgttcagtaccgatctcttcgcatatgaatatgggaatgctggctttattcaaggtgcccagtaattcaaaatgtgttcttgacatatgccttctctgcacctgagtcaacaattgtcaaataaatcctggggcaggaataagccaccgcgaatgaagaatgacgtgaggtttgaagacattatttcggttcaatatgccgcttcagttttgcagcggttttctgggaatcaaagaataaatactaaatactttcaaactttgagatatttgtttttggcggtgaagattcattgaatcttttataccaaatacgaattttttgtcctttgctcaagtcatctttattgttaagttgactaagtcccagtaaaactatatccgatctatactttttaataatctctttttcactaagattttcatagtctttaacattagctttttcattatgtatgaaaattgcttgattctctccttttaaaatgacatagccgaccatggtttgctcagcctccataaaatgtttgctttgggttttgacaccctaatgttatacttaacaaaattaacagcattgtacataatctatacaagttcaaaccgcccttcttgcatatttgtaacaagagtaaaacactgttttaggaaatgacagactaaaacgactcatttttaaggattttaacaacttccccgtagtcttatggaacacggcgaggtctttaccatcatagaaccgcacaattgcatcatgaaatatttaattggctgatcaaccacaacaccttctttaagcgatctaatgtggaatatgtgtaaggaggcggtttatttgaaaaacgatcagaaaataacacttgactcttcttttgcgttatccactcttattgtcttacttattgcattgtacccgtcctattcttcttggtttgtcacaatattctttttaggatttgcactaatatacacatttgaaaaaaagagcaaatcttcaaaactaattgctattatctcttatccattatttattgttgcgtttgtttacagcataataaacagcatgtaataatcccccgcctaagacagggttattttttatcacattgcagcaacttttgggccgcctttgtctgtgatgataaagctgtcactcccgattttttcttttgatccttatcttcataaatcgttacaaggtgttttgtcataagagccgtccctgccatcttacattcctgcttatcctaaaagtaaacaattttatattcacctagaatgatcattattagctaatccagctaaatcagatgaccagccccctgtaggcaaattaaaagcaaatcctaatgtttgaacgacagcagcagttgagtatttgtcaaagttgatcgtagacgttgctttcagtatcattccaagtctgagttatctcttttcgccttaactcctgccccaaaatcataaagcaaaccactccagtaaaattccaacaatttcaatcttgccaatggtgtttcttaaacctaattccccctctgagtgttttatgatattacactcctgaaaatatttgtttttgttaaacctacagttttattgaatcttctccacggcataaaatgggcatccccaatgagactttcggttcttttttaagaaaattgtgtctcgtataataacaaaagtatgtttttaaaattcttgttccttcttttataactaaaattttttaggtaatatattgatttcattacaaatatccattatatttgtaaatatattaaactaatggttatttaaggatggtgaagaaatgaagaaaaaacttatttcatttatcatggtgttcacgttggctgtgctggctatatcagttgtttctcctggctatgcaagtgcagcagaaagtaaaaaagcacctgtagttcaaaatagcgtacaggctcctttagcttcaaatcctgaagtacatacacagggcattcctttcgctaaacaaatattagtaaaagcacttagggttggtggccccgctttaggaaaccttattaaaaagatcccatataaatgggcacaaaaagctggtgatgcttgttctaagtggggacacaaagcggcggacgttatagatgaacttacaaatttcggagaaacagctgttactgtggccttagtgaaagccggaattccattagctgatgcacagttaattgcgaaggttgttgtgttctttttggtataactatacattaaaaacaagagagtgaggcttacaaccttcactcttttgttttaattaggtaaggagagattaccatgaatctgcttgttatgacgttatcaatttatcttttatctctcatcgtcttttttatttttatgtacagaggagaaaagaaagaagctgcagaaaaaaacacaaatgaaaaatttttattatctacagtaataggagctttggttttatcactcattcctactgcaatcataatggtgataatcttatttgcaacaggatcagcaaatgtgcttgtaaaattctttgaattagaaatagaatttaaacagattgttataacaagtgtgtgtatggttgtttattcttttacttttgataatatttttgtggctgttggaaggcatctcattggggataacttcttcaagtttatatttgcctcgttgtttaggtttttatttatttatatagtgggtatcttatgttccattgggaacagcgacaattttaaattatcattaggattaactttattttttcttttgttagaatgtattttccctaaaaagtctgaccgtgcccagaatttaaaatcttaaggacgggcatttggtgagaacattaattcatataaaaaaggaataatgttcaaaaagataaagcaggcttaatgtctgctttatttaattaaaatccctcttcatacagtgctttctctaagcaattcggctcctaaagctacactgaaccttccagctttatactcgtttacaacaataaagtaacaagcaagttgagaaatctcgaatcttgatatgctcaatggtactgttgtttttgcttcctgactttgagactgtaatgggacgctttatgtctaaaaaatctgcctataatatcgtttactgtgtagtcgatataatttatattaattggcattcaattgctaataacccgctcactgaacggaaaagcatgcttttagacattaaccttgaccataacaatgtatttgttattgaaggtctgcagggaaacggattagcttactttaatctgccaatgaaaagcatcttgaaggaatcgtcgtattaataaagctaactctccatatgggattaataaacattcttatagctggctgaaagtgattatagatttaagactacatggtaaactccgcataccttcctttgaatcttggagagtataatctctctattacataactccttaatgcttagcaaaacagactgaaaattcagtacataatacaataagttatccaaatcgtttagctgtaattcaccaaaatgctcttcatattttgtgacagattcattccagtttgaataaacccattgacctcctgaaattaaatgttattatttactttaacttacaaataaaggagtgtttaatttgaaaaagttgtttagttttattgtttgcaccatggtggccattctttctctgagcattgccactgccgcatctgctgagaccgacaattctaggttttcaactaagcttactaactctgtcgaaagtgaatttaaagcttttggtcttaaccctcctaattcaaatagcgttgtaaatcttacgaaaaacaaattgacattcgctggacaagcaactggcaatacgttatattcaaacagttattttcaaggcaaatcttcgataagctattcaattacaaataatattggaactaaactaactgtgaaagtttggaatgattccgactggatttttgctactgaaacactaactgtaaatgctaacggtacagctacaggaacaataaaaaatctagatgccaatgcgctttactatctatctttctctgctccgagcgacttttctggctatgttcaataatacgtaatctagcagctccattcgtggggcttttttgtattcgttaaaaactatcgtaagagagaattggattaattgtagaaattttgatatattagtaatacaatcgaatattcaaggctgctcctacacaaaaaacaagccagtgataaaatccttcttcttattattttttatcttagtgttaaattttttcacaggggctgattttatgtttctaataaacaattcttttgactttatgagcaacgtaacaacactagttgattttgttggcattgtaggtgcgataggctctgccttgagtatttgaataaaaactatcttttatctagacttgtccagctctctccaacatttcaaagagattgtgcctgcctcaattagtttggcattgtagtcttcaacctctttctttgcgctggccaatttatcaaaagctactcgccaacaccattatgaattttgataaaagatttaatcctcaagccatcaaaacaaacatctaaaattagtctattgcctgaagtgccatcaattttgctaaacgcagcttctttattgtaccagcataaagcacctcttcaatggattcattggtaaagtactcagtttccttggttgctacataggttttcatttcttcctcttactacgtttaaaatcacgatttcatcttcggtcctagtgatcttaagtcctttctctatatatacgcagagtgtatttgagttcgcacagtatttagtgaattgtatttgatatcaataacttcaatattaattgactctgttcttataaatatatttaatagcctatcaatttcaacccattcaccattgcaatattcatcttggaatagcgttattttaatcattgtctaacccttcctttaatgaactgctttcgtctaactttcggaaaacatattaatctgctaacaaatagctcatcgactttatcattgtattcaccatattcaccagagtcccattcaacacctacagaacctcgatttgtcgtccacaatataattcccatttctccattctcaaagaccttacttgctcccctttttgacaatcgagtatatttcaacctctttcttaaaataatcacattttaagttaactttaaactgcattatgttgagaatttcacctttaattggtaagctgacatctaagtcatacttatacaaagcaggtgatatattgaacaaaataatcggaatgaccggattaattatctccttacttgtgcaagggttttcagcaagtgattcattgactcataagatcgccatggcttgtctatttttgttcttattggtttataattttaaccatactaaggagttctctaaaaagtctctggcgattataggcgcttcctttattgtgctgatgcttgggatttatcaattgctctcttttactggtgattactttgaaagtctcggtttaaattttggaattatcctcttacttgagattgctttagttattggattagtgactgctgcgctgagtttaattaagcatattgcagaccgcttaaggaaaacacctgatggtaaagagcgttgactctttgcctttttttagctaaccatttctttttatgccgtctttcttgtacaaaatcaaacgcaatatcgacttttgccggctctgttctgtcaatgatgaattgatttcagaatgattcttaattcctcatcattcattggactccgccttaatggactcttcttcatttttcaccagaattttttcaaaagatccagtcgcatttctttctttgataagagctctacatttctaatagcaagattgaatattatttgttaatacactcggccccaacttttgcgtcttagaatttgaaaggcgtacttgcacttgaacatttgtcacttcagctgatatggaatcaatccttccagcccaattaggactctctccctcgggagtcggatatagtttaaatcgccaactgatctcccctgttttggaggcaaatccttcataaccgtcgtagcttccataagaagatggctgaggaaggtggacagcaagaatactcatattcgttctcgcagcacttggcgggtataactgcactttatagattagtgccgcacccttcgcatttttcaatttttgattcaccggttcgagtactgcactacaaggcattggacttgctttcatttgagttggagagacaataacagcagccaataaaggtataaccaaaataaatcgtttcatctaaattccctcacattttttgttaattttccttactcccgccttgaatattcatcacttttgaatggttagcttcattaaaaaaaaggtgaaaaaggcagtactgaagctactagcgctgccggtaaagatggaaaatcagcatatgaattagccgttcaacaaggcttctccggaacattagatgagtggcttgcctcactgaaagcaacaggaaattgatcatatccccttctcgaacgagggggcttctatcgcattccacaccaaattgagaaattaagaaaaaacactcttcctaatatattacattatgataaaatattacataatcagtcgaaatactaggagggtgatttttttggagcaattgatctcttcttcaaaggttggcttaaaaatcaataaatggtacaaatacataagattattcagtgttgcagatgcagaaattctaaagggtgaagttgaacaagaaatagagcatatggaagaagatcaagatttattgttgtactattcgctcatgtgttttcgacatcaattaatgcttgattatcttgaaccaaaaaccatgaatgaagaacgacctaaaatttcagacttatcagaagagatcgaaagtaaacaaagcgatctaaaaggaattcttgaatattattttaacttttttcatgggatgtatgaatttgaacagtacgaatatcttaaagcaataagtttttacaaccgagctgaaaagaagatatctattgtccccgatgaaatagagcgagctgaatttcactacaaagttgctgaagtgtactatcacatgaagcaaacccacatgtctatgcatcatattgttcaagcaatagaaacctacaaagcacacgagacatactcaataagagtaatccaatgttcattcgtcatcggtctgaattatttagacatggagtatccagaaaaagcaataccgcatttcatgaatgcattaaaacaagcacaagaaattgatatgccgcggttaataggttcttctttgtacaatctcggtttatgctcatttacaacaggacatatggagaaggcattggagtattttaaagaaggcgtctcaatttatcaaagtaattctcttcacaattctagccgactgcttgacatacttctaatgttggcaaaaacgcactttaaattattcaacacggtcgatggaaaacaggtttgtgaacaaggtcttatgctttcaaaggagttgaacgatgacgtattaggaaaaatgtttgattttcttatgggtttattcgttgagaatgacaaagaacgactttttaaaatcttagattacttagaatcaaaagctatgctttcggatgtggaagacctagcgactgatgcagcaatgtattataatgtaaatgaagaccataaagtagctacagccttttatgagaaagtgctttatgcccgaaaacaaattcagagaggggattgtctttatgaaatttaaatttgcatcggcttttatctttttagttatcttacttgggcttgttggacattatcttcttgacggccacaaagtttttaaagaagcccgaagaggccacacagccagtatccatatcgcgcttgatcaccataatgacttctcagtggaacgtagagggcaaaccgcataaatgttttggcactcccgcatagggggtgtttttttatgatctgtgttcacctgtaaagctctatgcaatgctgtccttcatagtaaaacaggtaagccttattcatagctgcaaccaaaaaaagcacaaataaatagtattgctcctctaaacttgtgtggcaatcatacaaaaacacaaaaggaacagacctaaacagtaatggagaagcacttgtcacatctggatattgaccgctcatcaaaaactgtctgctcctaatcatttactttgcagatttattctgcaagtgtgtttttttatataaaagatatggagcgttatatgaaaaagtcttatgttttatatgggatttcaggagttctaattggtgcaatagttatattgttgatcaatgcattctttataaataaaggtgaacactctgtaagtacttctaaaataaatccaaccgaggataaaatcttttttatctattcaaatccactcatcaagaaaagcgtactcatatccacatcacaaggagaaaaattcaataaacgatactttaaggtaccggatataccatatatccagaaaaaaaccccctcttcagacgatatcgtcttgttagctgaacatgaaccatattattacacattaaaaaacaacactattaaagaacataaattatccaatccatttgctttttggtatcaaggagaagatatttctgtaaaagcctataatgtcgacaccaatggaaatgaactgaaagtaaatgataaaaagttcaataaaaaatatagcctgactttgcctaccctcgtaaccatgggaggaagcgataataggtatatttacgtcattcaaggaatgtctatgtacgtcattgatagaaacacagaagggattattaaaacgattggattagcttcctatggagatgtatttgatcactctgaaaaatatgttgtagctagctcagaacatgaactaactgtaatcgaaaaaggatcatggaaatcaaaattcataaaatatcctgatgatctcgaacaagcggacgctgtgtattacgacaaaaaaagcggtaaattttacgttacatatattaataaatccgtatacgcctgcttacttgagtacgataaagatttttcttttgaaaaattcgatttaaaatttccgtatatgaatgcaaagtttaaagatcaaaaactttatgtaatttcacaagaggaaaacaaaaaagggattggtggctatatggggatttttgatatccgtactaaaaagaaacttaatgaatttgatttgcctgaagaagaaacaaaagtgcaggactttatggttttagattaaacataaagaataagttgcaaagcaaaagccccttcctgaataaggggctttaattttaaattaaatagatgttttatacgcgttaatggcttgatttctcaaaagcatattatctttcgtaaccattccaagattgtatgcttgtttgatgatatctaacacttgattatcagtttcagttacagctcgtcccccagttattctggacttccagtaatcaaactggtgatttaactctgaactgcttttaaggtttttattatcaactactttgccattctccagcgcttctttgaattcattaaaaccaattgaacattgcgtattcgaactaattcctgcaccttctgtcgctaaactgcaaaacgctaaaaatttcggatctttcgtgatattgtaagagttatttagaccttccataacattcatcctctctcgaattttacaacgttgctataaatgattttcatgtttttcccaagaccttcaacttgaatctcatttgaaggaagttcgttcattggaatttcaatgtatttgtcccatcctatcacaactttgttttgtccaagtatagggtcatatttgtatatgttcgcttcacctttgtataacaaatttctcccatcctttgctttaatgacggtcgaatttgtatagcccataaagcgaactttaatatgcagcttgtcacctttcaaaacatttgttgcatttggcttgctgcttgtaacaggctcccatacaaagtcgtttccatccgatgtgacggaaagaatctgaagactgtaaagcggtgttgcttcaattgcttttgctttcgatgtgctaatggaaaacatcgttgtaacagcaagaagtgtaattgttactaaactaagtacttttttcaatcccttaacctccttggtattatttcacatgttatttatcggtaattccagccgattatttaactcaaattcaaaaaagaacctgattctaacatggttcttttcgcataggtaactgaatgggtttttaacgacatataaatgattcctgtacattaagtatgctcacttaagggaatcttggagtcttggagtcttgctcaccccctatagaaagggggtgatgcttatgtcaacatttcaggcattaatgtgaatgcttgcatttgggtcgtttataatcgccctgttgacgtatataaataaaaaatagacctcccttgagcctgataacctgaagggttaggtctatcatgaataacataacatctgagcaagccctttgatgggttgcgaccaacaccatgctctttttattttatgcatttcttgttaaagaaatacactataaccagtctgtattttacagattgattataacagattaaatgaaaccattggaatggtttgcaaaacttttgtttattggataaaatcattattgtatttggagccgataagcatctttaatgtatcaatgcgctttattactttccaaatacttctcatgttgtctttctaaaaccttaatatcctttttaatgatctcaactttatattcttctttaacttccttagataagttatcgtttagatagcgtcgtaattcttcttcattttttgttttatccataccaattgatatgactgggtctgtttctccaattccaaggctaaataagccaaattcatcccatgcactttctaatacttcctcagtggatttttgatttttaaaagaatgtgtaactgcgccatacatgaacacagaaaaacaaacaatgatcaagaccccaattaatttctttttcattgtctcctcctttcatttcaagaataccataaaatacaatacatggaaaaataattcctcagccaacagtatcctagttcattacgggttggttttgagaggataaatgctaatccgtatcttaataacgaattagattagcttaagttaccgtctatcatcgtttgtgaaagtaacctcccacacattcaccataattctcgggaattttattttaatactttaaggagttttacatattcatcttcaccaagaaataatacggttgtaaagcccttcttttcatatagatgtcttgcgtttaagttatctgtatctacaccgaatgttatttcctcaaatccaagttgtttagcataatcaatcaaataatcaacaataataccgcctatcccgcaatttcaatatccttctttaacaatcatacgagacagataaatgcgtttatccggaatggtataatctgggtcattgttttgaaaaactaacgatccttctcctataaactcgtcattcactgagtaaataaaagtaattctgtttccgcttactaattcgtcataaaacaccttagccattttctttttcttttccatgtcccaaatattattacacttatggtattcttcgggttttaatttctttacttggtacgaatccataacctctctccctttttataattagtttctatcgaaaataaaaaagctctctttctgagagcttaactttgcaatacttttcctaacaataaaagctaattgtccttaccaaagagcaattttgcaaagtcattgtctaaaacctcaatttccacatcactgtcattattatcagtttcaattggttcatctactaaacttagaataaactcttcaaaagagttggcaataaggaaaaagtctttatcggggtgacttaattcatgatcccaaaacaatatcttttcattatcgatatccatgcatatttcattcccacctgccgagcttgctataggaataatgttcctgggaaagcgatcagaataagtattgattgcttcttggagactgttatgatcgttagctaaaccatagaagctctctattaattgtgtatcatcttcctgacccatccaaggatctttctctataggtttgtagcaaacgtcatactcaacctcatctgttgtttttttactttctaaataacagcctccatatcccttcaaaaaatccttatagtcggaaggcaattgattacctatatttctttcaatttctttgagctgctcgtttgtattaatgctaggatctgtgccagcattaatcgtaaactctttcaacttttgtttgatcttagtgaagctcattttaatactccttcatatgctatggaaaaacagatatagaccttctttttagttttaatcgtcccagtcctcatcatcgatccagtcgtctttcgattcttcaagctcttctattaaaaactcttggaatgtcctagcaacttgtttaccatatccctcttggttatcccaaagaatgactgggcattctccatctatcatcttgttagtgtcaagacaataagaaaattcatctacatattcgatcactacaagaccatcggaaaggttataatattttttatattcattggtctgctcgacaacttcagcgccgtgagagtcatatccgagaatcattgttccgtatgctcccctgaaccatactcagttaaaaaccatttatagctgtctggaagagttacattgagctcctcttctatttctctaatctgatcttcagtgactcccccgtgagaattgaattttctttattttcatcaaagaaagtttttattttcgaataatccattaaactttcacctcttattcttgattctcaaattgctgagctctccatctccaataccttcttctgaaacttttatattgtttatcaagcacaggatcatttctaaaactctgtccattcccttttaatccatgcaaaacatcactgtacttattatgccagctttcaggtatctccagcatagtaccaggctcttcttgaattaagtgatgtaaatttatttgcgtgccatctttagcaaacggagcattaccatttttcatcagttgaagattcgtaaagcctttacgatttttttgattaaggtcaatatctttcattgtgtatactctacggcttacatctctaggctctcctttaacttttaccttgccgtctatttcataggcctcatacttctctttatttaaccaagggacatttactttctgaccagtaaatggctttctgctttcatccaatttctttgcactggacaaaagtccatttttaaggttttggctgttaaccacattgtatggtacgttatcagccagagcaagatcatacttagtgttataaggaagcaaatctgaaatcttaatgtccttaattttctgacctgcctgtcctgccttgtttatgaccttccccgccgcatcagctttgttaacggctcctgcgccttttgttccgacgacagccacagccactgaaccgaccgcatatgtcacccatcttgatctggagtaagcatccccgttcaccatatctttttgatacgattcctcaatagctgttgaaatggcattatacgtgttaattggatgggcaactgcccctatgataccttcaacaacttcatcaggcttgctgatcagctgccacaaaccggttaccgtgtctttcccgacatcataaaggccgacgccggctccttttaaaatatcccaggtcacttctccggcttcttccatctgttttgcttgttcaagctgcatcacatattgttgttgggaaggttcaaggttctcgtaaccgatcttcttggcaatctccaagtattcatcaggatcagttactccatcagagagctttttcttcagatccttgatttctcgctctttcgcttcttcttttttaatcgtcaaataagcatctgaatgtcttgcaatctcgccttttttcttatgtatgacactttctctgtacgccttgacgttatagtgaagtggtgttgcgtttttccctttacccgtggcattttggagctgttgaaagtctgcttggatgaaattctcgttcgcttcggtttctgcgtattccttcgttagatcatgatcgagctttccgagcttgtgtacggtattgtcccgtttcttatctgctgaatccagcttttgatcgacatcctctgtcgagaaaacatcaagatgaacaatatcgcttatctcattaagaatatccctcatttcattccgctgctcctgcatgatagcttttgatttattcttcgcattaatcagttcatgttctaaaaatgactcttccacaaacgaatcggtcaatccggcatcagatacttttccagaaatactgttaagaaaagcaatcttcatatcgatcagatcaagccagctgtctgtaacacctgcgtgatcttgaaagaatgccttgatgttatcagcacctttgcccgaaaactcattgtcatctaaatcagccattccctgaaacgcttttctgagattgataaattgttctctaatctgatcgtattcttttgcccgtttctccgctactgaaattaacgaggatgcttcaaatactttcatttacgtctcctttctgcttctttctgtctaaattttaccatagctttattatttgattaacagaaaaagacagtccgttccgactgtcatacacagttttatctcgtcctgtaataattttcagctgtatagtatttccagtcccaaaaagcatccccgttcgacataatatatcggtctaaaaatatttcaaagtttaaatttaatggattatattctgaaccactttcaaatataaatagataattaggatcaccttgattcactctatccttgtcgatcattaaatgacattcttccaacaggtagccacaggtattccattgataccttcaaacaaaagctcgtattttagttcttcttctatttcttcaaggctaaatagatgaagacctcctccaatattctcgccctctgaaagaatttcgaaaattttcgcaccattatgctgagaaataaacttcaggtaatcatcaggaagagtgaatttatgattcgactgaaagttttggatttcactaagagacgctttgtttggagaaaaagtcacaaggctctctacaatatatccctcagaacaaaacaatttaatagcccctttttcatctaaaagacttttcaaaccattgatagtcttatggacaaagttagtcaataaaaacacccccatactcctcagaataattactgaggatacgaatttgttaatcagtaacaattttattcataattgaagcagcacttgtggtgaacaaaatgtaagtgttatttgctgttttaattactatcctatccgtagagccagtttgaagtcctctgaggcttcttttttatttggtacattcaatctaaacaaaaaaccacagagcgtgtgagggactctgtggcctatagtggctgattaaacccctatgatacatcaattaggattttatcaaaacttttcttttaaagataacatcatctctgtctcaaataatgcctgcagcagctcatctatattaatttctttctgcttgtaattattcttttcataagtacgaataatttcttcatattctgatcgattatctcctttaatggagctaattccaagctcttcaccgtatcggttaatgaatagttgtttattcatttctttcgctttatcattttcataattacaaaatgcacctgacaactggacgagaaaagtttcatcttcagaatttaggttattctcgtattcaatgtcagacagaatattgtacgaatacttctgtttttacagtaaatacaataaagaggaggtgctgtttttttggagttaaaaaacatcgttcattcttacaacattacaaatattttgggttatctcagacgctctcgtcaggatatggagcgggaaaaaagaacaggcgaagatacgctaacagaacaaaatgaactcatgaataaaatactgaagtcgattgaaatcccctatgaattaaaaatggaaatcggatctggagaaagcattgagggtcgccctgtttttaaagaatgtcttaaagacctcgaggaaggcaagtaccaggcaattgctgttaaagaaataacaagactcagccgcgggagctacagtgatgcgggacaaattgttaaccttcttcaaagtaagcgattgattatcattacaccatataaagtttatgaccctcgaaatcctgcagacatgcgtcagattcgttttgaattgtttatggccagagaagaatttgaaatgaccagagagcgtatgacaggcgctaaatacacatatgcggcacaagggaaatggatttcaggactagcgccttatggataccggttaaacaaaaaaacatccaaactagtcccagtcgaagaaaaagcaaaagtcgttcaattcatctttaacatctttttaaatgggttgaatggaaaagaagttagttatacagcgattgcttctcacttaacaaaattacaaataccgactccatcaggaaaaaagcgctggaatcaatacacaattaaagcaattctgcaaaacgaagcgtatatcggaactgttaaatataaggttagggaaaaaacaaaagacggtaaacgaacaattagacctgaaaaggaacaaattatagtatcggatgcacacgtccctataatagatcaagaacaatttcaacaatcacaagagaaaattgcaaacaaagttcccctgctgcctaataaaaacgcattggaattaagtgaattggcaggcgtatgcacttgttctaagtgcggtgaaccattatctaaatacgaaactaggcgaacgcgagaaaacaaaaacggcacggaaagtgtgtatcacgttaaatcactcacttgcaaaaagaataaatgcacttatgtgagatataacgatgttgaaaatgccattctggattacctctcttctttaagcaacttagataataagactttaacaaaacatatcatttatatgatttctaaatacgaagacgtaaatagtaatgtgaaaacaaagaagcaaatgtctgaacatctttcacaaaaagaacaagagttaaaaaacaaagagaattttatcttcgagaaatatgaaagcggcatttacactgatgaactttttttgaaaagaaaagctgttttagatgaagaatttaaagaactccagattgccaagcatgaactcaatggaactcaagaagcgcaatcagaaatagacagtaatacagtcagaaacaacataaataagataattgatcaatatcacattgaaacaagcacagaaaaaaagaactcgctattaagaatggtcttcaaagaagttatcgttacgatgacacaaaaaagaaaagggccaattccggctcagtttgaaatcacccctatcctgaagtttaattttacgctttcgatctcaccgccactgatagttcctcaaaatgcagtaaatgtcttaaaaaaccgataaagccgtttccccggtaaacacaatgggagctacgaagctgttgtccgagaagctgtttcatcaggcgaatcatcatgttcaaaaccgcggtacggtgttttgttcggtccgcttcggcaatgtgctcggttcacgcggttccgttattcctattttatttgagcagttgatggcaggcggtccgctcaccattacggataaaaacatgacgaggttttttatgtcgatcgatgacgccgcaacgctcaccctgcaatctgcggcgattacaaagggcggagaaacgtttatttttaaaatggagtccctgaggcttgaagaactgcttcacgggtttgaagaatatgcgttccggcacggactgccgcagccagccgctgttgaagtgggaaaacgccccggtgagaagcttcatgaagaactgacctctcctcatgagacggaatctttatatgaatggggcaatctttacgcgatattgccggatcccgccaaacatccggaatttcggaaggtcaatctccccagatatcaatcggatcaggcgccgctcatcacaaaagaaacaatcgtaaagattattgaacgattacatgaagaaaaaaaaacatagaaaaaaggcctgtctgataggcaggcctcattgctgagctctatttttcaaataaatgcaggcaggcttcatagccctcttccttcagcttgtctttcggaataaaccggagtgccgcagagttaatgcaataacggagaccgcttggccccgggccgtcattaaatacgtggcctaagtgggagtccgctgttttgcttctcacttccgtccggatcatcccgtggcttgtgtccagtttttcgtcaacctcttcttcctcaatcggttttgtaaaactgggccagccgcaatgagaatcgaatttatccagagatgtaaacaagggctttcctgatacgatatcaacatacagcccctcttctttgtgatcccagaattcattttgaaacggcggctccgttccgttgttttgcgtgacttcatattgcatgcggtttaatgatttgattttttcttctttattaaaagccatcttatctgtccctccaatgctcatccagaaagccttgacgtccggaacctacacggtagcgcccgtagtgatcaggatttttcttataaaagtgctgatgatagccttccgcttcataaaaaggctcagcctttaaaatgtctgtgacgatcggctttttaaatatgccgctttctgcaagctgtttttttgaggcttcagcgatttgtttttgttcatcattatggtaatatatcgccgcccgatatgaacttccgcggtctgcaaactggccgcctgcatcagtcgggtcgatctgctgccaaaacagctcgacaagcttttcatacggataaatgtcaggttgaaatgtgatttgaacggcttctctgtgtccggtcgtttcactgcacacttcttcgtaagtcggattctcagtatgacctcctgtatagccggacaccaccttttcaatcccgggctgttcgtcaaacggcttcaccatgcaccaaaaacagccgcctgcaaatgtggcgatttcttttttttctgacatacgggtgccctcctttgttcatacgtggtattattatattatagcatgtataaacagaataaaaataattctgctctcaggagaagctgaacgaatgccacgctgactacatattggaggttcatgatttgaaagtaaggacacaaatgatgtatgatatggaagctttgcttcgaaaagtgtttaaacaaatcagaaatgaagttaatgaaattctagataaagagctgtccaggaacgaattcaccattttgcggattctcagtgaacaagggcctaaaaaagtaacggaatttgcccccattcttgaggtctccgcaagccacattaccgcagtgaccgatgctttagtagaaaaggaatggatcacccgcatccgttctaaagaggacaggcgaattatcagaatccatattacggaagccggggagaaaattgtcgatcatttcaaccagaaaaaaacagaatacttttttaaacggtttgactgctactctgatgaagagcttgcaacgttaatcaaactgttcagcaagctagacaaaaaacgctgacacaaaaaaacacaaatccctgaaaggatctgtgttttttttatgaaaacttattgtttcggatgataataggaaaattcaatttcatccgtgtcgagattgattttatccgcttttacatacatgccgttgtctaaaggcatttctgacagacggatctcgatgcttttatccccggaatgaacgtgcacaaatgacgggagttcataaaagctgtccatataattcagcacaaagctgattggcaggcttaattcacctaatgaaaacttcgtcactttcaaaaccacatctccgttctcctgtacggacggttcaaatgtgacgaccgcgttaatggaggttgagaatgctttgattttacctgccacgtgcacatcgttattgatgtccactttgtagtcaagctgattcgatgccttctcttttaagtacgaattcacaaacctggcaagtgattctttggagcttgtgatatgaaagccgtactcactttttgtctgatcttgtattttcgcctgttctcccggcataaccaataatgtcacaattaccgcggcggcaatcacattgagtgcgagaagaacaaaaaacagcgatttccattttttcatcatttcaccctattctgctggtaacccttgtttttctatgatgccgtataatcggtcggcgatgagtgcatacccttttgcgttcggatgaaaatcatcatcctttgaaatccgtctgctgccgcttttttgactgaacaagtcttcaacattcaccgcagcggcgtgaggatctttttccagctcttttgcggcgatcttgttccaatccgtcacaaccccattaatttcttttaattcaggcagcgtaaacgtgaatggattatacatgctgacatacaccagctctgcgttttcattatatttgcggatttttgaaatgatcgtcttgaaccgtttttcaaaaggtttctcttccttttggaacggctgaaccgtcagctgcatcatattctggcggagcaccttcattaagtcattgccgccgatggtaaaaaagatatagtcggcgctccttaatgatttctgcacttttttattatcaagctttttcagcaggtctgacgttttgtcgccctgcaccgcataatttttaatatctaccgttttcacatgtccctttttcttaagagactccgctgtcttgccgacgtatcctgaaccgtcaggatctcctactccttcagtcaatgaatcaccgaccgcagctatgacaatatgatctttcgttttcggttcttcagcgtcagaaccggtgcgctggacagaacaagctgataaaagcaaagccagtccggcgatcaatgagaacattcgcagcttcaatctggttgctccttccccgtctactagtggaaagtgtaacatgttttttcagttttgaaaatgtctaatctgccagtttacttgagctcctcagccgctttgacatctgagaggatatcatcatacggaaccttctgcacgccgtcataatctttaagcaccttgccgtcaggtccgactaaataaaaagaagtttgatgtatgacctgatcctctccctccggctttttgacgattgctttaaagctgttcagcgcaaaatcttcaatgtccttttggctgtaaccggtcagaaaatcccagttgcgaagcgaaagcggatatttggaagcaaaggctttcagctgtttcggcgtatcattttcaggatctacactgaatgacacaatccgcacgtccaggttctcagccttcagttttttttgcagttcggtcatgtgggccgtcatcggcggacagactgtattacagtttgtaaacataaaatcggcaatccagacatgccccttcaggcttttcagtgacactgttttcccgtcttggttctgatatgaaaacggctcaatctgatagttcagcgggtcttttatcgttttccccccgcaggcgcacaagagcagcaaacaaaagacggcagcgaagcttttcatttttttcatttccattccccccatagataaaacgcttacagcgttcatcataaaaaaattcccgcaccctcccttatcaaaaggaaggcgctaaggaatgtgcaccgttatgcgttatgttttaaaatctcttggctgaaaacggcctcataatctttccacttcatacggcgcttgacatattgtcggaatgaatacactgttctcacactttgtgaagcaaaaacttctctcaaataaagctcaaggtgctgatgaatttgaaaaaaatattgttcaccttccgtgataaccggtatttctgtcacttttacctgaatcccgtcctgtcgtttgaactctaggcttttgagtaacaagatatcaatccttctttttcgattgttttctttttattatatacaatctgagaaagcgtgtctgtcattttgcgcggccgttctaaaaaaagtcagattaacaggtggaacagatcctgatctttattcacctctacgtaatgaaatcctttttgattcatccgggcaatgagcgcgccgtaatcttcccgatgcttaagctcaatgccgaccaatgcggggccgctgcttttgttattttttttcgtgtattcaaaccgggtgatgtcatcatcaggaccgagcacctcatcaaggtattcgcgaagcgctcccgccctttgcgggaaattaacgataaaataatgctgcagcccctcgtaaatcatggagcgctccttcatctcctgcattctgccgatgtcattattccctccgctgaccatgcagatgacgtttttccctttaatctcttctttgtacagatcaagtgctgacacggacaatgcacccgccggttcagccacgatggcgcattgattatataattcaagaatcgtgctgcacacttttccttccgggacaagcaaaacgtcatcgacgacggtttcgagcgtttgaaaggtttcagcgccgattttttttacggccgccccatcgacaaatttatcaattttctcaagttcaaccacttgtccggcttttttcgattcaaaataggaggctgcgcccttcggctctaccgctatgatttttgtatccggcgagatgtttttcatgtacgtgccgatcccggacaggagtcctcctccccctacgcttgcaaaaagaaaatgcggttcgacgtcaatgtcatttaaaatttcgatggcagccgttccctgtccggccatgacatcgggatcgtcaaacggatgaataaacgtgcggttttctttttcacagcattccgcagaactcttatacgcatcatcgaaagtgtcacccgtcaatatgatttcaacaaattcttttccgaacagttccacttgggatactttttgtctcggtgtggttgacggcataaaaatcttgccgtgaatgccgaggtgtttgcatgaaaacgcaaccccctgcgcatggtttcccgcacttgcgcatacaattccgttttcagtctgctcttttgagagctgcctcattttattataagcccctctgagcttaaatgatctgactacctgcaggtcttctcttttcaaatagatattgcagccatacctctcagaaagtctgtcattcctctgcaaaggcgtatgtatcacaacgtcctttacgttttggtgcgcttttaaaatgtcttttacctggatgagagagtcttctttaagcaacggtttcatttacagagtcctttcttatttaaatccctatttaatatgccattataacatgaatattcaaacaataagataattattttaattttgtaaataaaaataaatgaaccgatacaagagaaaaagatattttcgatcgcataaacgtgttatacttaaaccaattagaaccaaaaggagccaatttatgagtgtaattgaacaaactgatcctttttatcagctagccggcgaacatcacaccttttcagaagcgaaacgattggcctcgcaatttgccttatctgatttgccggtcttcataacgggtgaagtcggaaccggaaaaaaacaaatggccagagcgatccatcataaatcccgcagaaacagcgaactatttattaccgttcactgcagtcaaagcgaagagcggctcgaatatgaactgttcggggctgaaggcgcattaaacagggcccgccgcggaacattattcttatatgaaatcggagacatgccgctctcggtacaggcccgccttctttccgagctggacgccgggctttccgcccgcatcattgcaagcagcacggcgaatcttggcgataccggcgcggaaaacacgttcagcatagatttattttacaggcttcacgtgttaggccttccgctccctgctttatctgaacgaaaaagcgatataccgcttcttctgcagcatatgctgacagcctcggggcagcatgttcatatcgatccgtccgtttatccgctgtttgagcggcacacctttaacggcaacatcagagaacttgaaaatgcggcgcactatatggccgcggcagcatccggcagcacgatttatcccgagcatgtcccgccgtatatcaaaaacagccagaaagcgaaaaccgctaagaaaaaagaaaaacggctgacattgatggagaaagaagagtttttgtttattttggaagcaattaaagacttaaatacaaaaggcgaacccgccagcagacggagcatatccgaattaagcgaaaacagcacaatgacattaacgccccagcaagtcagaaacaggcttgattacttagaaaagatgaactatgtgacaaaaggccgaggacgcgcaggaacaaaaatcacattagaagggttgacctttttgcagtcactgcaaaaacaaatcctttaaaaaggaggacatttgattgttcacaataaaagaagaaatcgcaaatgccgtcacacacggaatcggtgtattgctgtcgattccggcgcttatttttctcattatctttgcggtgaaatacggctcgccgacagacatcgtcagcttttccatattcggcgcttcaatgctcctgctgtatctcagctcgactcttttgcacagcatccagcataaaaaaacgaaagacattcttgaaattgtggatcattccgcgatatacgtattaatagccggaacatatacgccatttttattaggaccccttaaagggacgctcggtctgacccttttaattattgtttggtcgcttgccatcggaggcatcgtgtttaaaatcttttttgtgaagcggtttatcattttttcaacgcttgtctatttaatgatgggctggctgatcatcatcgccattaaaccgctgtacgcttcgctgtcaggtcccggtttcggccttcttcttttcggcggcttattgtattccgccggcacaatattttatatttggagaaaagttccgtatcatcacgccatttggcacagttttgttttaggcggcagcgcctcgatgtttttctgtattttgttttattgcgtcaaagttccctttatctgaaataaaaaagcacagcctctcgtatagagactgtgctttttttatgcacggagccgtttctgaccggccggataataagcgggctttatatgtaattcaatatcagccggtttcagccgtttcaataacctgccccgcagcagccggtctgttcccgaagtgctgacgggcacaatcgggagatcgaaacgaagggccagttcctccggattgattttgccgtcttcggacagaatcagactttgccctttttgcagccggacttccgcctcctgaagcactgcatcccggctgtctccgccacaaatgacacccatcagacgcagccaatttccgagaaacggcatccggaaagctttctcgccagcgataaaaccagccggctcttcaagatgtcccgcaagcagcagaagatcagccgggcgcaatctgggatgcacatacaatacggggccgtccggtatcggctgatcatgatgaatgccgattgccgatcccgacacgtcaatgcagcctctcataaaggctttcggccgctcatacaccagcctcatctgtttttgaaaagagagccgcgggtcaagctctttttgattgatatattcctgaatatttttcatgaacataaatacaacgtacatcacaaggcagccgtaacgaatcaattcttgtccccctgcttaattctttttctcgtatacaaggtactcataatcgtaagggtttttttcatcttttactccctgtttgcgggaggtcaattcccattcagcttcattaaattccggaaaaaaacggtctccttcaaagacatggtgaatttttgtcatgtaaagtctgtccgcatagggaaagagcgcactgtacagctgggcaccgccgattacaaagcattcttcatccgccgggatcagcttgagcacttcctcagccgagtcggcggtaatacagcccgggaatgaagattcgtcccgtgaggttacaacgatgttccgccggttcggaagcgggcgtccgattgattcaaacgttttgcgccccattacaatggtgtgacccgtcgtcacttttttgaaatatgcgagatcatcgggaaggtgccaaggcagatcgttatcttttccgatcagccggttctcatccatcgcaaaaataaacgaaatcatacgctgacagctccttttatgtgcggatgcgggtcataatcctcaatgataaagtcttcaaacgtaaaatcaaaaatagaatcaacatttcgcgcaaaccgcagtttcggcagcggacggacatcccttgtcagctgcaaattcacctgctccacatggttttggtaaatgtggacgtctccgaatgtatgaacaaactcacccggttcaagtcccgtcacatgcgcgatcatcattgttaaaagcgcataagacgcaatattaaacggcacgccgagaaagacatccgctgagcgctgataaagctgacacgacagttttccgtccgcgacataaaactgaaacaggcagtggcagggcggaagcgccatatgatcaatttcgccgacattccaggcgctgacgattaaacgtctggaattcgggtttgtcttgatgtcatgaatcagccgggagatttgatcaatggtctcgccgtccgctccgcgccacgaacgccattgagagccgtaaaccggtccgagttctccgttttcatccgcccattcgttccagatgcggactccgttttcctgaaggtagcggacgttcgtatctccttttaaaaaccaaagcagctcatgcgcgatggacttaaaatggagctttttcgtcgtaagcatcgggaaaccttcctgaaggttaaaccgcatttggtagccgaacgtgctgatcgtacccgttcccgtacggtctccttttttttctccgttttctaacacatgacggcacaaatctttatattgtttcatttttttcatccttttaaagtagtcttttagtagtgtaacacaataaaaaatcatttctgcaaaatttctcagaaatgatttttttatttcttctcgctattacacgctcatccagtcaggcggcgtattgcggtcccagtaaatgctgccgagctcatgatgtgattgaaatccgtcttcagcggtatggtaatgaaaattaaaccagtagccgtcttgcggaggatgatcccggcggacgtggaaccttaaaagatcttcacctgtcagcctgttatacacatgaaaaattttttcagtttttccggccgacggtttactggaaataaccacatcctgatacgcttcatcatcttgaaacttggctaaatgtcctgtgatgacatcttcgattttcggcagaatttcacttctgtaatcatcttcaatgaccggagagattttgctgccgaattttaaaaatgattgattttcagcatcaccgagaagctgctgctgatacgattgaaacagtaattcaggctcccgccctgccttcgcttctcccgtcagggcgtgttcatcataaaaagcggtgtaatcattctgctcaagactgctcgactgtcctgaaggcttgtctgtcatcaaagcagccggaggagacacgagtccgaacgttacaatggtaaacagaaccacaagggtctttttcatccacaatttcatgatagattgttcccctctgttttattgtcctcttttcctttattttagcatagattaaagcgcggcgtcatgtccggcaccgtattatcatgcaatatgggaaattggtaactgtgaccgagtggataaaccgcttacaataagaaggagaaaaaggaggggatgagatgattaacgctttatttgcgactgtatcacttctcacgctgctttattttgtcgttatggaaatcactgattaacgaaaaagaagcccatgatatcatgagcttacatggatgacaccgaagtggaaaagcgccgtctttcttttcagcaccttgaagccgtatcgttcaaaccgcgggcttttccaatggtctttaagcactacgcattttttcgccgcccggacggcttgcgtgatgcactcttcgttaaaaccctcttctgccagcgcgcggagcggtgcaatgccgtctgacgtttcaacaggttcgtgaaacatcgggtcaaaataaatgacatctaccgatgaatcaggaagctcccgcaaataatcggcgcagtcggcatgtttaacctgaatgcgtttcatggcggtttggagctgctccattccggtttcccacgtttgaagtcctgtttctacaagcaatgagacaagcttgtttttctccaggccgatgacttgtccgctttttccgactgccaggcttgccaaaatcgcatcggatgccaggccgagcgtacaatctaaaaaggaatccccctcgcgtaatccggctgcttttaacaacggctcggcttcccctctcaaaaaccgctttgcgcggaacatcgctgtattcgggtgaaaaaagaacttctccccttgcttcgtgtaaagttcgaaccgttcctttccgatgactaaaagatcgctagcggctcgttccagcattttttcaatgggctgtttattgcggctgcagtaagtgtcacccagcctgacactgagtgactgcgctgtgtgtatcgtgtattcgcttggtctgtaactcgttgtgatcatctttttctccaaaaagaaaatgcccggaattcgggcatttcagcagtgcgcatcgaaggcatccgtcagatttttcataatttcctccatgtcatgcccttcgatttcgtggcggggaataaaatgaacgacctctttcccttttaacagcgccattgatggcgaggaaggttcctgccccgtaaaatattcacgcatttttgcagttgcgtctttatcttgaccggcaaatacggtaaccgtatgatcaggcgctttttcatgctgtaaaacagcctgagtcgcagccggacgggcgagaccggctgcacagccgcacacggagttgacaacgaccaatgtcgtgccctctgcctgttccataaagctttctacttcttcagcagtcgttaattcctgaaaacccgcacccgtcagctcacggcgcatcggcacgaccagctggcgcatatattcttcataagccattgacataaaaaagccccctctaaaaatccttatatgaagtcaaggatactatagagggggccggaattcaattgttcaggcctctgttttatattttcatgattccgcctgtattggcgcttgttacgagtttggaataccgggccagatatcctgtttttactttcggctcgaagcctttccattcggccttgcgtttttcccattcttcttcaggcacttgtacgtccaaaatccgtttttctatgtcaacgatgacatggtcgccgttttctacgaatgcgagcgggccgccttcagccgcttcaggtgatacgtgcccgattgaaagaccccgggacgctcctgaaaaacggccgtctgtaataagcgccactttcgggccaagccccattccgacaatctgagacgtcggagcaagcatctccggcatgcccggtccgccctttggcccttcataacggataatgacaacatctccttcttttactttgcggtttataatgccttcaagcgcggcatcctgggaatcaaagacgacagcgggccttcatgtcttgtaatcccgtcctgtacgccgcctgttttgataatggcgccgtccggagccagattcccaaacaggacggccaaaccgcctttttcggtaaacggattgtcaagcggatgaatcacgtcataatcctttacttcatgacccgcaattgtttctccgagtgtgcggcctgttacagtcagcgcgtcaagatgaagcgccccttcttttttcgccaattcattaagggccgccgagactcctcccgcttcgtgcagatcttcaatgaagacgtccgaggccggcgccaatttcgataagtgaggcacccgttcagccacttcgttaatgcgttctaaagagtactcaaccccagcttcattggcaagcgcaagcgtatgtagcactgtgttggttgagccgccgagagccatgtctaacgcaaaggcgttgtcaatcgctttttcggtgacaatatcgcgcggcttaatgtcttttttgatggtctccatcaattgggccgctgattttctcacaaactctcttctctccggtgaagttgccagaattgttccgtttcccggaagcgccagaccgagcgcttcagacagacagttcatggagtttgccgtaaacatgcctgaacaagatccgcacgtcgggcagccgaactgttccagctcctgcaggtcgctttcaccgattttcccggcttgatatgcgccgacgccttcaaatactgaagaaagcgaaattttgcggccgtcgcttgtgcggccggctgccatcggccccccgctgacaaaaatggtcggaatattaatccgcatagccgccatcagcattcccggcgtaattttgtcgcagttcggaatgcagaccattccgtcaaaccagtgcgccgagacgaccgtttcaactgaatcggcaatgatttcacggctcggcagtgaatatctcatgccgatatgccccatcgcgattccgtcatctactccgatcgtgttaaattcaaaaggcacaccgcccgcttccctgattgcttcttttacgatttttccaaattcctgcaggtgaacatgcccgggaacgatatcgatgtatgaattacagaccgcgataaacggcttgccgaagtcttcttcttttacgccggcagcgcgaagaaggctgcggtgcggcgctctgtcaattccctgtgtgatcatgttgctgcgtaattctgccatggtgatcccctactgtttttagactgtgcactatttttaaaattttcagtttattctagggcgcgttctgcaaattacctgtttacagcgtctttgccctgtctcgcttttctattctttctgtatttcgataaaaaccctccaacaattaatattgtacttactatatagagttttgaatcatttttcaacaatattctaaataatttttataaaaagtgaattcaaataaaaaaggtgcatggcgcacctttttgttataactgttctttttttctgctttcagtcatctgtttccagactgaacctttcgcctcttctccgtgctcaatccgttcaatcgccattttgacttgcaggctgacttcgaattccggatcgtcttccgccgcttttaatgcttccagtgcgctttcatcgccgacttcatataaaaacatggccgcgcgccagcgcacgagcttgcttgagtcactgagcgatttcgtcatagccgggatggcgctcgcatcgccgagatccgacagacagtcacccgccgtccttctgaccgtcaccgttttgtcttcaagcgctttgtataacagcggaagcacagacggcttttcgatcattcccaaataaacgacggcttgtcttctgatcgaagtcttcggatcatgcagcgccttttctaatactggtaaatcgtcttcatccggatccatttgctcaagatgggcatagcgctgtttccagtcttcatcatcgagcatttccaaagtcactttataagctttccgctgcactgccggtttggcctcacccttttgctgtacggctgcttctgtcaggcgtttgagccgctcatcactgtaggcggcctgaagctcttctgtgacatcgtgtccgatttcggtaaaatccccgaagcgcacgccttgttctttccaagcccgctcaaatacaacatttgaagcttcggaacgcagctttaagatggcttcttggaaacgttccggaaggccgaagcgctcttcacgttcgccgtccgtcaatttgacctgcatcgggattccgctgaacatttgtacgaaaaccttcacttcaccgaacgattcctgttcagaacggctctcagactgctccgtatgttccattccgaaagcggaacggacctgaggcagaatgtccttccagtcaaaacgggcgtttctctccacagccaggaaatcggcaacgtgataaacaccctttactccttcaatgtttaaaatatcacgtacgacggccggagcatcatctgcctgatcaggcttgtaattgttgcttttccccgccggaagctcttcagtcaaaatcactttcatcgtgttcggactcggcgtcggttctattgatttaatcttcatattggtcctcctatgcgcaatctgacacttattctaacatagtcggcacaagcgttctattgcgccgcttagcttttgccgatgccggcctctttttggatacgggcggcgaactgcaaaagaaattgatgccgctcctctgctaaacccgcccccgcttttgtattcattaagcctttaagcttgattaatttatcctctatatgggccagcacacttgtttgagttccgtacatcgggtgacccttcgcgccggcaaacataaaagccctgccgatgcccgctgcgccgatcgcatcaagcatgtctgcatcctgaacaactttcccctccaaggaaagcggccgctttatcagcagttccctgtgtctgaatgacattctcgtgatgatatccgcgatctcctcaatggagccagccgcaatgttgaaagcagccagccgttctgtcacttcgcctgccgtcagcctttcgcttttttcgagcttggcgtcaatcagatcatgaaccagcgcggccgtctcagtgataaataagtcggcgccttcttcttttgccatataaacagaaagtgttgcgacccgggaaatatgaagccagtcatggcccgtacgttcattgataagcttttctctgacccaattcctgacgctttccagctgctctttttcgttcaccgtatcacctcttatcgggccaaaagcctctgcaccgtatcttcaagctcttttgggttgacgttcggtgaaaaacgcccgttgacttcaccgtttcggtccacgataaacttagtgaaattccatttgaccgcttttgtgccgagcatccccttcgcctgttccgtcagatatttgaagagaggatgagcgtctgccccattgacatcaactttcgcaaacatcgggaatgtgactccgtagtttttcacacagaactcttgaatttccgcttcatttccaggttcttggttcatgaattggttgcagggaaatcccaatatttcaagaccttcctcccgatatgtatcatagagctcctgaagctgcttgagctgggatgtgaacccgcatttgcttgctgtattcacaatgatgatcaccttgcctctgtaagccgatagcgtcatgtcttcgcctgttatggtccgtacgtttatatcgtaaattgtcatctgcggccctcctttttacattcttcatttattttacctgttttacactgcaaaacaaacggtaaccgctttttccttccacttaacggaaaacgtttttttcgaggaaccaaacggctctttacccgtcataataaaagagccgctccgaatttatacccatttgccgcttttatccctgtcattatgcgttaaatacggtttattacgccgggatggattgaaaaatggcttaaaaatttctataatgaagaaaattaacggggaataacggaggtggcatgttgcctattaatataccaaatcacctgcccgctaagcaggtgcttgaaagtgaacacatctttgtaatggatgaaagccgggcttttcatcaggatatccggccgcagaagatcgtgattttaaatctgatgccgaaaaaaatccaaacggaaacccagctcctcaggatgcttgggaattcacctttacaagttcactttacgtttttaattccgagcacacatactccaaaaaatacggcaaggcagcatctggatgaattttatacggatttttccagcatccgccacaaacggtttgacggaatgattattaccggggctccgattgagcacctgccgtttgaggatgtttcttactgggaagaattgaaggaaatcatggaatggagcaaaacgaacgtcacttcaacactccatatctgctggggcgctcaagccggtttatactatcattacggcattgagaaagtggagctgccgaaaaaaatcttcggtgtgtttgagcataccgttcttaaaaaacatgagagattggtaagaggatttgacgagctatactatgtgccacactcacggcatacagatattaatacggagcagctgcaatcggcttcggatctgaatgtgctcagcgtttcagaggaagcgggggtctgtttaatcgtttcaaaagacgaaaaacagattttcttaacgggtcatccggaatatgataccgatacgctgcttcaggagtatgagagagacatagagagaaatctttcaaacgtagaagctcctaagcactattttgcgcccggcgggaaagaacctgttaaccgctggaaagctcatgcaacgttattgtttatgaattggctgaattattacgtatatcaggaaactccgtatgaatgggattaatttttgttttaagtgatacggtgacaaaaatatgataaaatactcttgattcagtatgcgtataacaaaactttaaaataatggaacatatcaattaaatttagtttaaatatgttggcgcgcttattataaaatgatgcacttgtgttatgtttatctatagacaataactccttacgatgcatgaagcttgcttgttgttgattacattgaggtgaatttacttgaataccaataaaaaagtattaattttgactgcaaattacggaaacgggcatgttcaagtggccaaaacgctctacgaacaatgtctgcgtctcggcttagatgtgacggtttccaatttgtatcaagagtcaaatccgattgtttcagaggttactcaatacctttatttaaaaagcttctcaatcgggaaacagttttatcgtttgttttattacggagttgacaaaatctataataaacgcaaattcaatatttattttaaaatgggaaataaacgtttaggccagctcgtcgaagagcataagccggacattattatcaatacatttccgatgattgtcgtaccggaatacagacggagaaccggaaaagtgatccccacgttcaacgtaatgactgatttctgccttcacaaaatctgggttcatgaaaatgttgataaatattatgtcgccacagattacgtaaaggaaaaactgattgaaatcggcactcacccgaacaacgtaaagatcacaggcattcccatcaggcctcaattcgaggaatcgatgccgaaagagccgatttataaaaaatacaatctctctcccgacaaaaaagttcttcttattatggcgggagcgcatggtgtgctgaaaaacgtaaaagaactgtgcgaaaatctcgttcatgacgatcaggtgcaggttgtggtggtatgcggcaaaaacagctcgctgaaagaatccctcagcagcttggaaggtgacaatgccgaccggctgaaagtgctgggttatgtagaaagaattgacgagctgttccgtattacggactgcatgatcacaaaaccaggcggcatcacactgacggaagcgacggcgatcggcgtacccgttattttgtacaaaccggttcccggacaggaaaaggaaaacgccattttctttgaagatcgcggtgcggctgtcgtggtcaaccgccacgaagaaattttagagtctgtcacctcccttcttgcggatgaggagaagctgaaccggatgaagagcaatattaaaagccttcacctccccaactcttctgaagtcattttgcaggacattataaaagaatctgaaatgatggccgggaaggcggatatggcattatcgtaaaagaaaagcacacgaacgattcgtgtgctttttgtttttttccggttaagctttgttactggaaaaataaagataaaaaatagggagcggccgcttgacgcccgctcccatatggtgtatagttgaaccatcatttaacaacgtttacatacgtacggttggatgatgacaaaattttttttagcacgaaggtgctacagtactaggaggaattaagcaatatgcaaaacggtaaagtaaaatggttcaataacgaaaaaggattcggcttcatcgaagttgaaggcggagacgacgtatttgttcacttcactgctatcgaaggagaaggatacaaatcattagaagaaggacaagaagtttcttttgaaattgtcgaaggtaatcgtggacctcaagcttctaatgttgtaaaactctaaactcaatacatgttgatcagatgacaaatagaggagaggcgtatgcctctcctatttgattgccgtctgaatctcaattgcgacaagattctgcttacagcgctgctcgatttcttcaatttgtttctccattgacggcattccttttttcgccatttccgctaaacttcccagatcaccgtatatttctttaaatgtctgctgaaggattgtttttaaatcattatcattcacggctggtttttcccttctctcccaagataccctgaataatagtaaataagccctaattaatcaggttcaatagttatatcggcttattttctatatttttttctattttccgtacatatttctaaaaaaaatctccaaactatttgcggaggtgttttttaatggactctgaattttttccaaacggactgacggataaacgccagcttgaattagcggtggaaacggcccagaaaacaacgggagcggctacccggggccaaagttcaactttggtggagtctgcttaccaggcgattcaggatgccagaacgatgtcacaatccagtgaactgcaagctctcgaccaggattttctgcaaaagcagcgaatgcttctcgacgattgccagcatcagcttgatgaattcgaaaaataaaaccgcagaagctgcggttttattttttattgatttgtcagcaccttgccgtaggctttcagcttctcccccaccgtgcattggttgatgcagaaagaatgagcgtgcgtttttccaaactctttgcggaaatgcttttttacgaaacagtctttgcaatattcatcctgaagctctgtcaattctttataaatgctttttttatccaatatcagtcatctccgttaccttctaatgttatgcggctttcaatctgccggtccgagagaatttttctggcaaggtcatccgcttcttgattttcctttcggtttacggcttcatatgtcggtgtcagctttaaggattcgagcagcgcttcaattttatccagccattcgttttgcgtttcatcataacacggccagctgccgtcaagctgatgcaaaacgacgagggaatcccctcttatcgtgattgaatttctgcttgcgccaagttcctgcacttccttaagcgcttcgtacaaagcggcatattccgcctcattgttcgtctgaagcgttaagcttttgtttttccgtatgcgatgccgcttgccgccgagagaataatacacgacaattccgagtccggcgcgtccgcttgttttgtcaaagccgccgtcgaaatacactgtaatgtcgtcaggttcgtacgcaagttcttcagtaagcttttctaattctttaagcgtccagctcgcgcctttttcatcctcaaaataaatgtcttttatataaggaaagcggctgacttctcttgcaagcatgcgcgctttcggaacggtcagccaatcttcggaaaaaaacgcgacagggcctgttccttttgcttctatttcgatatacggcttaagattcattgaaatcaccttaccattcattagttgacgggcgtgtgctataatcaaaccattctcaaattgaaaggaagtcagcaggttttgtttaacgatgtgttatggatcttatttgcggtcattcattttatcattgttcttctgttttataaaggatttggcaaaacgggcctattcgtatggatcggtttcgccacggtgtgcgccaacttgcaggttgtcaaaacagttgagctgttcgggcttacggcgacactgggaaatatcatgtacggcaccgttttcttcgcaacggatgtgctgaatgaaaaatacggtcccagagaagcgcgcaaagccgtctggctcggcttttccactttgctcgctttgacatgcgccatgcagggggctcttttatataaaccggctgcgtcagatatcgcgcagcctgcccttgagacgattttcggttttctgccgcgtgttgcactcggaagcctcttggcttttattttcagccaaacgatagatgtttatgtatattcagccattcggagaatctttccttcagacaggcttctctggctcagaaacagcggaagcacggcgctcagccagctgctggatacatttatcttcactgccgtggcctttatcggcgtttattccgcgggcgtatggttcagcatctttatttcgacttacctgattaaatttgcggtatcactcatttctgtcccttatgcgtatgcggcaaaacgaatgacaccgaagggagagtgacggatgatgcctgctgaaatttacgtggacggtgcaagcgccggaaacccgggcccctccggtatcggtatttttattaaacatgacgggaaaacagaatctttctcaattccgatcggcgaccattcaaatcaggaagctgaatttctcgctttaattgaaggaatgaagctgtgtgccgcccgcggatttgagtccgtgtcattccggacggattcagatatcgtggagcgggccgcggaacttgaagcggttaaaaacaaggctttccagccgtttgtggatgaaatcatccgcttaaaggccggatttccattgtttttcattaagtggattcccggcagacaaaaccaaacagccgatcagctcgcaaaaaaagcggtccggctgaataaataaccggaatgaaattgcgtttcactgttcatcctacaaatgaggtgaacagctatgagaaaagaaaataaaggccggcagaccgggggcgtgaatcctcagggaaatatggaaggaaatgcgcataaagacccgaaatcagcccttgaaaacaacgcaaaaaaaagcaatacaaaacgctagagggatcagctgatctctctggcgttcagcttttcgagcattctttcaattccttttatctgatggcgtctgagcattaaggatgcttcttccatcttcaatgaaaaaatcgcttcttcaagcgtacagactaacggcacctcgcaatgtatttcagcaagctgccttgacagctccaattctttcaagctttgctgaattttcgtttgctggcccttcggcaagagagcgaggctttctaataaccgttctatgttttcgtattcacggatcagcttgtacgccgttttttccccgatccctttaacgccgggatagttatcgctcgtgtctcccatcagcgccttaatgtcaatcagcgcttttggcggaacccccgtttcttctctgaatatctcatctgtatataccttataattgccgatacccttttgcagcagcgctacttgaacttgatgattcatcaattgaagcagatctttatcacccgttacaatcgtaatttccgcttctccggaaaatagggcagaaagcgtaccgatacagtcatccgcctcatagccttttatgccgatgtttaaaaaaccgagctctcgcgctgcttctttcgctaaatcaaattgcggaatcagctcaagcggcggttcgcttctgttggccttataatcttgaaacaaatcattgcggtacgttttgcttcccatatcccagcagcagacgacatgtgtgggctgaaacgtatcaaccgccgtaatgagatgctttaaaaaaccgttgacgccgtttgtcgggattccgttttcatttatcataaaattgcgatgaacggccgtcgcgaaaaacgagcggaacaaaagcgccatgccgtccacgagcagtaatttgttattcatatatcgaaactcctttttttattcaatgttcctattttaccaaagaaggcggtaaaaaaacagcatccccccatttggaagatgctgccgtcacgttactcaccgtgtcttttattgcttgccatcagcttttcagcttcacggccggcataagaatcaaatttctgtccgaaaccgtttttctttttggcattgttattctgctgaacatttctgtttcccagttttgttctgcccattgtcatatccccccttagagaagatacggatagtatgtacagcaagcgctgatgacacacgcggcaggttcatccattactgtctgctgacgaattctttcaccatctcttcacttacgaatcgtctttgcggcacgatgccctttttcgccagctggttcatttttgcggtaatgccattgatggcatctgtcgtgaacggttcattctgtctgcattttacaatggcttcttcaatggcctgttcacgctggtagtcaagctgtacaaatgttttgacgtgctgatgctgttttgcggaatgtgctgaaattgctttatggacttctgacataaaaggtttcatctcgcttttttcattttagtctaccacgactgttatctgcccgccaaccggatttttaaattttcagcatttcatctttctttttccatgctttttcggcttcgtaaaggtgttcaatttcccttgcactcgtattttccgcaagaccttgtaaataagtgtcccgctgctcgcggatctgggacaggcttttatccgccatgtcttcttgcagacggcgcacctgctcagtatatcgctctgaaaggctttctttctcctgctcaagccacttttctgtcactttttgcaggctgagcctgagcccttctacaaacgctgcttttccgttctgttcaaaaaactgcttcggcgatttaacttcttttatgtgatgtgtgaatgccgagacgtcaatgaccggagcgacttctttcagctgaacggcaaattcgttttcggcgctcacataaatggagaaatctccgtcttccataagcttcttctgacagttttccatccattcctcagtcatatggcgctcaataaaaccggtcatccggatatcgagcgttttcagctcttgaatatattcaaaacggaattccttgagcgcttcattcagcgccgctgctatattttgtttccaatcgccgttttgaaggcccggatggaaggcggttttcagcatatcattcgcataaaatgtcaggcgatgtttaatgtgatagagctgttcttccgtatctttcatcacttttcgaatgatgacctcagacgtacggcgctttgaaatgtcagcgagagctttttcataggaagactccagatgctgtttctttttctctttttcttctgccgactggtgaagagattcgtgaagctgttccaccatatcgcacaatttgtccgcctctgttttcagctgggcgcagctggccctcattacatcttcctcaataaagtgctcaagtccggttcttacatcagagaacctgttataaaaagctgcttttttacccgcaagctcttctttacttgagacatgatataattttggccggttaattccctcttttgagagttctgagcggacatagtctttgacggtttccagctcgctttcggttttggccagatcggcggcgttaatgacaaaaaacattttatccatgccgaatgattctttgacgaggccgagtttcttcagaaaagacctgtctccttttgaaaaagaatgctgatagtacgtcatataaaagaacgcgtcagcatcttttatatattgaaaggcaagttccgtatggcgcttgtttatactgcttgctcccggcgtatcaacaattgtgatgcctttttgcgtgagaggcgaatcataatacacggtgacttcttttacgcagcaggccgttttttcttcggcagcatacggttttaaatcttccaccggcaccgtcagtgtctgcctttgacggatctgttcttcatacgtatcaaacgcctgcagcatcgtctgaatcaccgggataagttcatccggaactttcccctttttaatggcataattccatctctctttcagtgaacgcccctttacatcagcgtctttcagctcagtcagctgaagcatttcagcgtccagatcctcctccgtcttaaaaacgatctccgcagatttatgcggtttgccggcttgcggtttcgttattttgttaatcgtagccgttgtgggcgtcggtgatgacggaagcacgtattcaccgacaagcgcatttgcaaatgatgatttaccggaactgaatccgccgaataacgccaaggtaaactggcggttttcaagccgctcaatcctgcttcgaaaggcttctgcctgttttcctaatatgctcgaggattcaagaatcccggcaagctcatagaaccgatcagtctgctcttttataggaagttccttcatcgcatttttttcgggtttgtttacttcatactgtacagtctcttttggtttctctttttggacgggcgcttttgcaaggcgtttttttcgcgtataccagtcgccgcttcccgtatcacaggtcaattcttcttcccacaaagcgcggacccgggctgctttttccaaggcattgcgttcttcttttgccgattgcgcgagctcatcccttatcttcttttctttttcgagccggtttttcaagttctcaatgagcggtccgttttttgcctgaacataagcggtaagcttctcaatgagttccgctgtctgtcttttggcttcccttctgatcatctcagcgaggtctttcgtataagttaatacgtattcagatgaaaaggccgctccctgcttaagggcctgagcggtgatatcatcagaaagcggtgtgcggtacgcctggattttcttgatcagttcgtccgaatccgcttcataccgcttggccgctttcgtaaatgtgtcgataatgtgccaatccgcttccccttccgttctttttttaatatcggcaaaaaattcagcatgccttctctctttctcctgagccgttttcgcttttgaaaagaataatccggttttaaatgagggctgctgtgattcaatataagcagatgcaagctccctcatctcaaagggtgtcaaattagcgttttgcaatatgttctgcacgtcttttctgatgtctttctctgctgtttcagcctgttgaacggctttattaagctcatcttcaacagaacggacaagtgcttcttgtttgtcaaactgctctccgcttccgtttttatcatcttttacgagcatctctgtatgctctttgactaagtgtgcgacttttctctccgttaaggaccataaatttgtttttgcctgctgtttcagcttctgcagatgttttttcagctgttccatgccgtttaaaggatggtcaggctcagtgacagacgtaaagaaaagcgattctttcggtattcccgcgccttcaagcatatcttccacctgcctgcggtactcttcaaacttcgtttcggtttcatcatgcctgtcaatttggttgacgatcagaaacaaattcggaatacggtctttgatggagctgagaaacagcatattttcttctgaatgaacgtgattataatgaacgacgtaaaataaagcgtcagcctggtggagaaccgaagcggcagataaaaaatgcgcttcgtccgtcgaatcaattcccggtgtgtcaatgtaggccgcataaggctctgactccttaaagccggcatagacttccaccgtttcaatttgctcaccgtctttacagaattgctgcacttgttttttatcgtaacttcctttaatttctgcataagccccgtccgtcgtatgaagcacgactttatcttcaccgtgccggatgacaacgaggttggcgcttgtgggaatcgggcttgtcggcagtatgtcttcaccgagcaatgtgtttaataaagaggactttccggccgaataatgcccggtaaacgcgatataaacctcttcatcagccgcttttttcataatggccgcgagctgatcggcccgtttttcatcctggtgatccaataattgtacgtataaggcacccgttctgctgaaaatctccctgttatggcgttcttcttctgtcatgtgtcttaacccctttgtgtctgtcgcatcaaatgacgttttcatttttagaaagctctgaaaaaaacctctcccccattttacacaagaatggcccacttttcttcaggaaacgtaaaaaagccgccgatatcggcagctgataaagaaaaaacacccgcggcattaaaaaccgcagatgtttaagaagacatcgatttattcgaaacttttttcaatacgaaaccaattaaaacactgtatgtacaaacggctgcaaataaaaataacattgtcattttcggcaccaccttgaatgagaatcattttcatatttacatcttatcatgagtgagaatgattttcaatctctattttgcggtgttttcttctagcgctttctcttcggcgcgaatccttacagtgagcatgcaggcattgagaatcgaaaagagaaacagtgtccaatacgctccgtataacagcggcagaaaaataaattctaagatgacgaccgcgtagttcgggtgcttcatccacctgtacggcccctttctgacaagctccgcatccggcacgacaagaattttcgtattccaataccgccctaatgataatagagcccaatacctgatcccctgtacaaataaaataatacatataatggcggcccaccttggagaaagcgttttttgaaacgccgccacctcagctgtaagagagacaaaaaagagcacgtgcatcaggacgagaaagagataatgtccttctccgtattcgactgcgccttgctttttcaccttctgctcattgcgccgggccacgatcatctccgcaatccgctgggccgcaagcagcatgataaacagccaaaacattaagaagcccccttttcccagctgaacagcaaaagctcagacgaaaatcccggcccgagagcgccgatcagccctttttcgttttctttctgccggccgcggagcaactgttcttttatcacatgaaaaatagttgcggaagacatgttcccgtgtttttgcagcaccttccgagatgcctcaagctgaccggtgtccattgaaagactcgttaaataggcgtcaatgacctttttcccgcctggatgggcaagaaaggttttaatgtcgtgaggaccgacaccatattctattaaaaattcatcaacattgtccttcagccactgtgaaaccagggtgggaatatctcttgaaaaaatgacttgaaaaccgctgtcggtgaattcccagcccatcacatcttccgcatccggcatcatcaccgattgagtggcgaatatccgcggaagaagcggctgtttgacgtcgtttcggttcgccttttctcctccgactagtactgcggcaattccgtccgcaaacagggaagttccgattaagttgctttttgacttgtcgttcggctgaaacgttaagctgcagagttcagccgcgatgacaagcacgtatgcttcaggatatgcgcggcagtattcgtacgccctggacaggccggccgctccgcccgcgcatcctaagccccagatcggtatccgttttgttttcgcagaaaacggcagctgattcatcactttcgcttcaatgctgggtgtcgaaagcccggtgctggaaataaaaaagatcgcatccactttttcataaggaaagggatttgttaaacaatccgggtttgttaaacaatcaagtgccgcatccgcactgtgcttaacggtttcttccgtatacagccggttcttttctgaaaaaccccgcgccgttttataccattcaatcggccggacaaactgccttgattcaatttcgccgttttgaaaggcttttaacagccggtcaatatccttaaatgaatcggcaaacatccctctcgcaaaatccgccgccgtttcttgcgagacatgatattccggaatgctggttccgaccgataacacatatgccatgcccatcacctcttcacataaaggtttccgcttttttcctgaatgtatgcataagtttgaagcgaggatttcactgacatgccattttaatttaaaattggcccttttgaatgataagccgctcgactatacttgatccattcataaaaaaaggttgtgataagaatgctgaagcccgtcattcttaaagggtcactcgttcagttagagccgatgacgattgatcacactcaggcactttgtgaagctgcttcagaaaataggacgacttacgcttacacccatgttcctgacggaatcgaagaaacaaagcgttatattgaacgtacgctttccgattatgaaaaaggacttgcattgccatttgcagtacggaatcttgaaacagaccgaatcgtcggaagtacgcggtttatggatgcggaagtgtttacgcggccggcggacgcagccccggaagtgtgtgagatcggcagcacatggtatgcctctgccgtacagcggaccggtgtcaatacggaatgtaaacttctgttgctgacccatgcgtttgacgcgtggcaagctgtcagggtgacgctgaaaaccgatgttcgcaaccagcgctcacgaactgcgattttgcggatcggtgcccaatttgaagggatccgccgcgcgcatattccggctgtcgacggcggcctcagagataccgcctactactccatccttcgggaggaatggccttatatccggcaaaacctttctggccggcttgcagcatataactgaaaaacctgccgatatatacggcaggttttttacatattcggatcatggacgtataaattgagatcgatccgtccgtctgacgtgaccgctacgccctcagcttcaagagacagcttctgtacagaaaatatctcttcatctcttaatccgatttcaccctttgcattgatgaccctgtgccaaggaagacgatgctttttactcatggagtgaagaatcctcacaacctgcctcgctccccgcggacttcccgcaagaccggcaatttgaccatacgtcatcacttttccttcaggaatctgtttgataatggctaccgcccgttccgtaaatgtcatgtaactcctcatttcgcaagagcagatgattttcgagaaaatcatctgctttctgatcttatttttatagatgataattgcttcatcatcatacttattacatctctgcgtttaaatagattatctgtttgttcacaaaaaattaacaaagataggcatgtacatgtttaacataatatgtaataatacaattgtattaaaaaagaaaaggagtgtttgcaatgaaaatgaaaaaagctttagccggctcagccctgtcactcgctttactctgttctgccgcccctgcttttgccgcaggtcctgctgatacaccttctgcagaaagcaaaacgaaggaagtatctgctttggcgacgttcatacttaatggttatggccctgattatcctacttcaatttaccggaatggaatcacctattatttagacaacatcaccttccatggtgctgatggcacttggacagccgtctacaaaagctgatttttcatgacggcggaatgattgtctcaagtaacaactaaaaagctgctaatataagggggctttgcccctttttttagtttcactccattttataattgatccagcatatagcacctaggtgcgtaattttattacatccgatgatcattattagttgtaatgtttctgcttttagacgcaaaaacacataaactaaaattctctcccgcgtgtctatccaaaagccgagtctcaactctatcaatccagaacattttatcgacgcctgagttccccagctaacgttaagaaacctcttacttgctctttcatttttgataaaacacaatctagggtgataacatgagatttgcttgggaagaattaattataattgcattcggaatgattttactgagaatttcagggagaaaatccattgcacaaatgaccatcgcacagacaatggtgatgatttcaatcggtacgattatcgttcatcccattttagaaaccagtttattgaaaacattaatcgctgcgtctatccttttagtgctttaattttgatggaatggtttcaagtaaaagtaaactggattgattttttttaaccggaaaatctaaattcgatatagaagacggccaactaatatacaaaacttaaagaagctgagactgacagcagatcaactcgaaatgcgtttaaggcttcttggcatttcaattaaatatgccactttagaagctaatggacaattaggctacgaattaaaagatgactgtaagcctttaaccatcaaagattttaaaaatgtgatcgacccaaaatgtcttaacaaagagcctcagccacaaaaagatgatcaagccaatctattcgaggaaatcaaaagacacagactcagcacaagccaaaaaatcttgaataattcgctgattagtaaaaccttttgttattcaaaaccaaagccgaatcagaccgttaaccgcgccgatcattttttaccagcccgtttttcaagaaacaaaaaaacatctgaagcagatgccttttttcagacgagatccttgtatgcgcctgaatatgcttttcagccgctatacccaccgccggccttagctataatgttaatcagtttgtttttataaaatcattgattaattgatcagtcgttaatattgtggcaaattcgtcatgcaatgtagccagagatatattgtgaatagtctcggcatcataatatgtatcattttggtctttcattccgaaggctgctgttgcatctgaaatgaggtaggtatcaaaccctaaattaccgctcattcttgtagttgttgaaacacaatggggcgtagtcaaaccagttattacgacagttgttatatcatttgattttaaaatctcttctagattagtcccgataaagctgctgtttactttcttggttataatgacctctttatccataggtttaacgatctcctttatagcaaccccctcattttttggataaaataaagaaccaggtttatcagaaatatgttgtatgtatatgactgtccatcctttttctctccataatttcagtattttactaatgttttcttccgcttttacgttatttcgttctccccattttttataatcgaaagctttttgtacatccacaatgattaaagcttttttcttttctgccaccagataacctcctatattgaaaattagtatttataacattttaaataaagtttttacttttgtacaattgtttcagttttaaatttcatatcacacctttcccgttggaaaagcgctggaatagctaaatcaaacactcactcaaaggctgcagctcaccagaggccagcaataatcaactctttttctctatatacatatcagtatcctgaaataagctgcaacagcggatgaaaggattgccccttttgccatccactcccctaaaaaaattcacgctgcgcccacaaaatattaacaaaaaacctcttggttattattgtattttgtgtaataatacaattgtattaaaaaacaaaggagtgtttaaaatgaaattgaaaaaagttttaactggttctgccttgtctctcgctttactcgtttccgcttcccctgcttttgcatccagccctggcaatacaaatagcgactcaactgaaacaaaaatttcgacacaagcgatcaaagattcttttacaatggattaccttcatagatgggatatcccaaatacaactgttaaaaatggtgttacttattaccttaagaaagtagagataatcgaagggttctatcgcgcaacttttgaaggatggattaattaaaagaaggggcttccccttcttttcactctcttttgtaaggatccgtgcacaagacactcccctcagcgcccattctgcagttgcacttcggcatcaggcatttcattccatgtctaaaccaagtttcgtgtcatcaccgtccgaacaatgatattcgtttatgatatgatcccccattctcctttttttcttacattcagtcatatgttcacgtacatatagttcgggacggttgttcggcgaaataaggcggatgccgcatcactcaatttatttcttttcaaacaatgaaactaataaaaaaagaggatgcctcacaaaaagttcagcaaactttcggaagcatcctcgatctcgggatttcataaagaaatgttattaaaatgttatttttttaagaaaaacggataactaaccctcttgaacccttgtcacatcaagggtttttttcgttttaggaatcatattataaacaatattcaaaaggacggcggtaaagcttccggcgacgattccgtttgtggtcagcagatttaagtaagacggcaggtgcttaaacatatcgggaacgacagttacaccgagtcccaatccgaccgaacacgcgacgatcagaagattttcctgctttttaaagtcaatttgactgagcattttaatgccgtaggaaatgaccatgccgaacatggccaccatcgcgcctcccagtactgaagacgggatgatggtcgtgaaggctgcgattttcggaaaaaggccgaatagcattaaaagtgcgcccgtgacaccgatgaccgcgtttttcttaatccccgtcagctgcacgaggccgacgttttgggaataggccgtatacggaaaagcattgaaaatgccgctgatgaacaccgccagaccttccgcgcggtagccttttgctaaatcacgttcagacaggcgcctgtttgtcaggtcaccgagagcgaaatagacgccggttgattcaacaaggctgacaatggcaacgattgacatcgtaataatcggtgccgcatgaaatgtcggcgtcccgaaataaaacggtttaatcatttgaatggcgtcagcattcgccacattgtcaaattgcacttttcccataaaatatgcgatggccgtcccgatgacaatgccgattaaaattgaaatggatttcaaaaatccttttgtaaaccgataaagcagcacgatgatgacaagcaccgtaaatccgagggcaaggttagccggatcaccgaaatccttgctgccttccccgccggcaatatgattcatcgcgaccggcattaaggtcatcccgataatcgtcacaagtattatagtttaagtacaacaaaaaaagagccggcttaatggctcttttcttttgctaataaattagacattacttcattcacttttaggttgactttcttaattgcttcagctgatggttgatttatgctttcaatcgttatatgatatttttctatttcaaacgattgctttgaagatgatttaacgaattcactcatacagcgctcacactctgctgttcttttttaatcaaatcatcgcaaagcttattcaagtaatatgtatagttaacttttttcttcatcgaacggacttctgtgccgatctcttcacaaattgcaattggaatgctggctttgtttactttattcttatatgtatgtttcaattgtttttcagctatgttcttatatgtaaggaaatcattaatatgtacgaaataaactttattttccggctctctaaattgaaatagaaacccagggattacgtttggatattgcgtagcctcttttaagtgttttatctgctgcggctttataatcttctcttgaaaggcaatagacttatcctttgttgatttaagctctaatgggaataagtaccccttaaagtgcaagaagcaatcatatttgttttttgatactgcagctcccctttttaaaaacactggattaacatctttaattctatagaagaacagcttttgacctgcagctgatttttctatatttgcttcaaaaaccttgccttggtttgtacctcccaatcaatcactctcctaaaatattgaaactaaaattgaaattagaataaacctttgctacactgttttatgttaattaatattgaaagaagtgttcgaaatgaagcaatggacacccctgcgccctcgtttaaatgaattaatgtttgaatatgacctcacagttgatgaccttttcaaacgtacaggataccccagacaacgtatccacgattatataagtggagctaaagcaaatatgaacttagctactggcatgacttttgctgatgccattggttgctcaattgaagagctgtacgaatggaaccacgaagaaagaagaaaagttaaatcttaatccctttccgagcccatctgatttcctgcatcaattcttcattattatccgaaaggttgattaggttacggtgggctctttcgtattctttgttctcgagagcttctttcaccgtacccatttgtctttccattttgttgaacagtatttgaatgttcttaatgtactcagttattactctccacctctaatcatctaattttatttttactctaaataaatgaccgattttatctaatgttcacttcaccttatttgattcaaaagacaagtgtacccgtatccaataaagtgcatcgctcgcttcatgaaaatcacctttaaagaaattcttcgctacactttttaataagtagaaaatatgtctccagtcgtcaaacttaaaactcataatcctctttatcattgaaataaccctccccaaatcactcctgctgcaatggcaacaatgaaaactgaaacaaatttaattacaccaatatacactgcaaatttaagattcccttcggaatccattcttgctaacaaaacaagcccaaatgcaacaaacaaaatccaagctgtaacgatcatctacttagaacctcttccaactgtatatccgccggcaatgtcatttaagatcgtggtaccataagaaacctttttactctcattgtctttatttttagtgtaattaatgaaatcatcgaactggtttaaatacactccgtaagctgtgttattcaatttataaacggtatcgtcacttggtttcaaaaaccagctgtcagtaccttgtccatatacttcaaaaacttgaacaatttcgtccttatgctcaaagtaagccagcttattttcaagttcacattcctcatcaactggatttccaacatgatttgtagcatattccatcatagaagtaagcatgtagcctaattcgacgtccgagaagcttaactgtggtttaggtgttccataataaatatctgcttcatttagtgatcctctttggttcacttctttaatgatctcttcgatagctctgtagccttcatgaatgatgaattccctacgttcctcatctcttcgtttatactcctctaataaacttgttaccttaaactctgtattcttcatctaattcctccttgtatgaaccgattatttctggtatccgttgaaagaaagtaataatgcaatccctagcatcatgtgggtattcgcaatcaatttcggcaccggatatgtaaatttcatattctatgctggatattagttgaggattataaggtagctcgaactgtaggcacatcctcagattaggtatctgttcattgacaaacttcaaaaacttcttctcatactcaggaacctgttcatataatttgtttgcaagctcttctatggtgtctgattgcaccttataaaggttctcaaacaatgttttgttaatggtcattagctcacttaaagcttttacagttttctgatttccagttagagtgactccccaccatttaagttcctttgtgatactctcttgcatttgctcccataagaaattgctattgtacccccttagtttattagaaagttgtttagactcgatatgtgagccattactgaaatgaatattaatctttctctctaaactattgctcacttttgactaacccccttaatcgttcaacttcatcaactaaccattcagcatagctaattttaattttcatcatctttgttgatctaaattctctagacattacttcaacaaatttcttaacttcatcaaattcaatctctttcattgaacttatcccttctaaatgaaatcaacattttattcagtatcaacaaattcaaatcttgatctgaaaaattcatcgtgttcataagccccatattcattgtctttagttgcaatgatatgttcttcacctaaatcatcaatgatttcaataccatcatcggttatacgaaaatcatattttttatttaatgtaaactctttgtcatgacagtctgtaacatatttaattttcacattagacattttactttctcccttctgtataaaattagaatttcatttgatttcaaatgtcttcagctcaaacgttttatacgtatcaacttgcttacctggtatctcatttactctaggatacatatcatagtcatatggatatccaatgcagttcatgtgaaagctcgttccatcattgtcaaactcagcttgtaaatgatcatgaccacaaacccaatgttttgcgttaatgaacgggacatcaaccatatagcagctgttaggctcaaacggagaataaggattgtgaacaggtggaacatgtgagacaaatacatcaatgtgagagttttcaagagtgtcataccagcccattgattctttccacattgctcgtaccccatcttctttgctgtatccattaaggctgatatagtttgaatcattagagacacctttgaagaaatcccatccttcatttccttttggaagataccacataacatctcctgcaaagactttccctttgtatgtatccgtagactttattaatggagtgacattattgatgtctgtagccttctgaattaaatcattcacccttcccaatgaatcggaatattttcgttgctgatttttactgagtaaataaagatcatgattaccatatgtgaagtaaaccttttcatactgctttgctacttcatcaagtacccacagtgtctgttgattccactcagtaaaatcaccggcaatgattaatacctctccatttccattcgatatcagccttctaataatctcccttgttcgcctttcccatttaatttggtcattgtcccaaggtatccagtgattaatatgcagatctgaaacataatcgattttcattttatcccccttctttgtttaagtacgtgttaattcatgctccatgaccaattgacatttaaatcccctcactttaaattaatgtgtatatttacaaaacatctccacacaatacaattgaacaagcttgtttacatacaactttaggagatgatcatatggctcaacaaaacagatcaaacaacagcaatgaattacttgtgcctcaagctgctggtgcccttgaacaaatgaagtatgaaattgcttctgagttcggtgtgaacttagggcctgagacaactagccgagcaaacggttcagtaggtggagaaatcacaaaacgtttagttcgcctagcccaacaaagcatgaatggccaatttcattaatgtatgaggggattactcccctctctttttatgctcctcttccaaatccataaagtactactggcattgtattcacctcctttagtgaacaaatgtacttcgtctaaccagctcgtttaaaacgatttgaagttttcttctttggtcttttatgtatgcattgttatcggtacgcaatccatcattaattctattttgtatgtctgttttcagtctctctaagctttcaattggtaatttttctagactaactttatatgattgattcattttaatagcccccagcaaaaacgagtgaaattatcaataaccaaaagactgctccagaaacagcaagaaagctttttgcaatactcataaactcttgaaaatcattcttcaacgactctttcactgcatcaccttctctttaaaatacagattttacttagatttcagttgttttgaactcttgtttactcaacagctctaaatagacacgattacactctgtaagttcatattcttttttctgaagtttcctttcaagctcagttatataatcgagaagcctaggaatgtcttgccgagcgtttgcgatgaagtccgcgtcttctttagttactgcagctgctaaaccatcctcaagagtaactatccaataacgaagattttcgttccctggccattcatggtgaatgtttgcatgccaaaatcctttggttgtcgcttccatacgttgacggatttcttcgagttgatctttcgttaatttttcattcattcctcatctcccactttcaattaatttgattctcaatttcctcaataaatccctctaaagcttcttcatcaaccattacttgtccaacctggactttgatgatttctttcattcggtcatccatatttctaaattcttctgcttgctgcacagtaaacattgatctgtatttctttatgtataaaagaaattctttaagtacaccgatctccccaattttgtggagattggaatcttcttgttccacttctagccggagtaaagctgcttccttttctaaaacatcaatttcaagctgttctttctttgacagcaattcttgctctttttgttgcaatatatcacctccttaaagttctcaccgaagaaattcacactccattcagaaaattcaccatatattcacaacattctccatttatttcaaaattaattgttataatatagttgtattacatacctaaaccaagggagatgcttttaatgaagaaaacagcaattgctttattagtttcaactattggtcttactggtgtagctgcgtcagcgaatgctactgctaaaagtgagccggttgccgcccctcaaaataatcttgaggtcttaacaaacaccggtagttttcatgctcttgggactgatactcacgttaaaaatggtgttggtgaagtcaacataggtagatctacttcaggccctgcatcttacgcaacagtagtcactagctttacaccaaacaacgtaaccaagatttccatcatggggaaacaatggtcaacagggacaggaagtagaagtgcaaatgtgacttatgaattaatgaagtcagatggcactgtgctggcttctgttacaccgagtggcggaaattatattagtgaacaattttacaaagtatttagcgtaaacacatcacttatttcaggaaaacaattgtatgtccgagcacataacaatgacagtgtagctcaagtaaaagttaatgttgatgtttattgggattataattactaatacattgagagggcttccctctcttttttatttaattatgtaggcttgtttttaaaccgattcatactgtaaatgcttgtttttctttttgctaattttatattctgcaatcttcagtgattcaagagtccatccattattgtttaaacttccgaaaagcgtgttcagtaattggagctcttgttttaagcttcttcgctttctcaatatcttttgacctttcaacgaaaggtgatatccctctgaagcattaaatttgtcctcttctagcttgtgataaaattcattgagctctttatcaactttccctagctctttataaaggttatcaatttcattttgaagtcgttgtttagtctcctcaattgcaacaagaggtttggaaatggaaacaagataatctgttgcagttttcatatcgccactcctatttattattttatttttattctaaaagtatgtaaaaaaaagacaagcttttaacttgtctttatcttatcattcaacttctaaaaagtctataactattttatttttattctaaaattattttgagtaagtcacaaatgaataattaaatgtggtattgttgtctgctttcctgtgatccttttcaattactctccagtcatcatttaacctgggaaaatatgaatctgccttctcagcaactgaatcaacaatcgtcaaataaaccttatcagcatgtggtaagaatgcctcgtatatagcacctcctccaattaccattacttcttcatctttatccaattgtcctcttataagctttaatacatcatcaatcgaatgataaacaaatgaagagtgatcaggcttgaaatccttatttttagtcaatatgatattctttcggttctgaagtggctttcttgtaatgtttacgattgaagcgtatgtaagtctcccctgaatacacaactttcctgtagtgagttctttaaaacgtttcatgtcttcaggaatatggtaaagcaaattattttcatacccaatggccattgatttatcgcagcaagcaataagagatagcattatactgctacctcaaagtaaagcttgtctccatgcttataattaaccaatttgaaatcatcaattgtgaaatcataaaaatcttttacatctggattaatccataactcaggtgcttcatactgctctctgtccatttgaatctttaaattgtctatatgacgagtatatacatgacagtctccgatattgaagatatactcacctagctcatagccagtaacttgagcaatcatacgctgcaatacattgtactggaacacattaaacggattcccgagtgcgagatcattactgcgacagaaaacttctaaatgcaacttcccgccttttacaagccattgagtaccatagacacagggagtcaatgccattgagtctaattcatcaggattccaaagcgttgtaatatgtctgcgtgatgatggattatttttcaactgatgaagaagataatcaacctggtcaaccttttcaccgtttagcattctgttcttcttaccaagctgatatccatatgctttgccgattgtaccgtcttcttgtttccattgatcccagatatgtacgcccatcttgtttaattcgtcaacatcatttgatttaagctgccatatccaaagtaattctctgattgccgttttccaagcaacttttttagtcgttaaaatcggtacttcggaattatcaaagcgcatttgcttactgattacacttaatgtatgtgctggtgttccatctgtatcccacttggttctgacatcgaattcttcgtcagatgccccattattaattatgtcatttatgattgtgttgtactgcatatcaaactgagtcataattctattctcctttatctaaaccaactgataataaagttaaccacgaagacaatattaccgcaaacaaaaagcatgtacacgaacttgttttgtttattgtttgagtcaccgtccaaaacatcaagaattttaaacattgttaaaccggtatatattaaagcaaaagctgttcaagctaacattagcaagttaccatgcgtaatcagtccaatagtagccaaggggataatgaacgaaatccccttgaacaatgtcatgacatacactaagttcttattcttcttcagttctttatatggtgagttagaaagcaaatgtgtgactttagcgtatacgttctgttcccctcgagtaattaatctaatttcattaatgtttagtgcaaataagtatgctgcaagtattaacgtaaagtatgtaattataatacatccccctattttattttttagagcagaggaattaaatccaactgctctggttaaatttattgatagatcgggtcgtagcagtttctatggcaccattcaacattgccatgcgtttggtacatacatcgttgaaaacatcgttcagcactattaaagtgggcaatgtatggtgtaaattgtggcaagtaattcaaagtatgcagcgacggtgtgtaccatattggatattgtctaaacacattaaaacctccagttcttcacagttttcaatgtattgtatttaagttcacacccaatcgatacttgtcactgtttatatagccatgtttaaaatttaaatatcaatcaaaaagctcgccggctctcttcatgtctttaatttcttcacttacactttctttgattgtgtgaggtaactgatcaattctccgttggattcttttctgacctgtatttcttatatgtaaagttaattctttaaacccttccattgattcgtctgaaattaaatcaaactgatgttgaatcttagctaataagcttatgtattcttcttcatcttcactgaataattggaggccttgtttaaaattttctatttcttttagatgggcttgtattttctctatatgtttatccatttttcttcacatactctttgacaacatcgacaatttcatgagtattgtggaatacagtttgccctaatgaagtggcatgagaataaagagggtgattatcaatatttttaatttcttcttgtaaacaatcaagaaggattctttctgttttcactgacacttgttctaacagccaactgttcccgttgtccatagaaagctgaattcttatttctggcggcaagttcttaaatgcattaataaagtcgtcaaccttatattgatcagtaggatttagccttgttttaattgaaattttcattttcaaatctcctttttgttttaatttgattctaataaactcaaaaaattaactgctgcaactctatacctttggtcttcttcataagctgcaacttgtttcatatgctccaaaaacacatctgcaagcccttgtttttgaataaaccccaaacaaagtccgtttctgaagagcatatcatcatactttgcttgcaaatctttatgactgttattgtttatggtctgtttcctcctctttattttaaataaaagtcttcttttatagagatgttcgttcaatcgacaccctttggtatccctaagatctttatcaactttagtcatcacaatttcgcttgtttctaaattttgaacttgtacatattccctttcctgtctacatgatagtgtccttttggataatatacatgtccatctgcatttaccttatcaattacattaaacatgaattcgccctgttttatattccctgtcatccacgcctttttgcgtaatctttttttcatccagcatctcctttgtaggcataattgttgagttttttgagtattttaagttgtaccctggctgagaccctccactgacaaacatcatgatcaaagccaggggtttaaactaataaataatatctgccacgtatttagaccaagattctaaacgattaaatactaatggattatcaaaatcttgtttatttaaccaaaagccttttaattgatctgtttctcttacagatacctctgcattttcaggcagtttaacaataatcattatgcctaaatgaactttccccacttcatttaagtcatcgtttatcaaccccacaacttctaaatttaaattggaagttgagataaacacctcttctgaaagctctctccttaagttctcatcaatagcttcccaaaaatttgttgcttcagttaaattcatgtgcccgccaacaccaattgataattgatcatgaagcctcttttccccgctttttcttaaccgctcgtatgcaaatactcggtctcctttttgtaaaatggcatagggaattggttgcttacagctttgatccctctcagcatctcccctattcatagtgatcatgctttcagcgagattttcgattatttgatcaaccttgcctagatcagattcaattccttgaaagactagttcttcattatcaaatactttatctctaggtgctacaacaattacttcatccattttccccatttaacattctccttttgttttattatgtgaaaaatctatccaaaaattaaataggccgcccaacatgaatatcgttgaataatccagtcaatatgcttaatcttacagaaggttatccaatccattatcaacaaaggtattacagtaattaaaaaaattaaaagcagtatgtacttccaccatgaaatctcgttaatattccaaccgaatatggttagccctcccctaaggaaattatcttttattgtaatccctttagtagttcatcaagttcttcaggcttaaatccaacactacgctttacttcttcttgctcattcagcagtatagtcaccggtacactcattacctcaaattgcgctgccacttctggcttctgtgttacatcaaatgtctcatattcgactcctgcttcgtttaaataattggataccattttgcaaggattgcaattcggttgttctaatttaatcagtctcatgaaataactcctttgctatcgaaaatgaaatcagaatcctttaatggttcaaccgttgcttttttatagccaacgcctttcattgaaaagaagtcatgtgatttagtctttgtgctcaatccattaataacgattggattaacatcctcttcttcaaaccaatgatcaaagcccagattgtttaatgctttatttgcgttgtatctgatgaatttctttacatctggagctaaaccaacctgatcataaacatcttctgtatactccaattcattttcataaagctcctgcaacaagcttaaagcccattcaaacaattctttttgcatctgaagagtttgtttcttatatatctcttgagctaacaatccgacataaacgccgtgtatcgcctcgtcacggataattaaatttacaatttccccgctctgcatgagcttcccttgtccataaaagtaaagtggataataaaaccctgagtaaaacaagaaactctccaaaaacacggacgctaccattgctttgaataaggaaatatcatcgtttttctgaactgcttcataaattgaaacaattgttcttgctttcttttgaagaaatttattgtttttaacccattcaaacacttcgttgatctgctctgttggagctaatgtaagaaagatgttgctgtaagattttgcgtgcaccgcgttttccatcatcgccatgaaattaagaaccgcttttcgctgatggccctcgacgtgctcggccacaatcggcatgcccgtgttcccctgctctgtatcaagcagtgtcaggccggcgagcaccttcatgtacgtatcctgctcatttttacccaaatacttccaagtaagaagatcgccgtttaatgcgatctcttccggaagccaaaactgctttacgttttggttgtaaaacatttgggtgaaatcatcttcatgctttgaccagtttgctgctgtatattgcgtcaattattcatcctccttctctttaacgaccatattgaattttttgatttttgctactaatccggacttcttcgtctctccacatctagcgaaaggatacgtactatctcgattccttcctagctttgattcgacgtatttatcgaaactcgcataatccgcccgctcccagaagaaaattttagcccattccggctgctcatcgaatgttatgctttcgtccttaaatgagtctgcacaagtatccactactcctccgtagatcctaaagttttcatgtgggtgcttttcactgacccactcttgaccgatttctaacttcacgactccgcctccccttcgtttaaactacgcaactcaagcacgaatcctggccggtatctttcgtccgcgcataatacaacgttttaatgccacgatgatgcgcgtataaatcaatccggttcagatcgcgcgttgtcatcgtatctttcaagaacagcgtaaatgaaatcccttgatcgacgtgctgctgaatagtggcaataagatcaactaccttaaacatatccatgtcgtatgcttccttataaaagaaccaattctgagccgataaacctggcattggataatatgtcttactgtttccgtatgtacgttcctcgattctctccataatcggcattacaccggctgtagatgattgaacatatgagatgcttccagtaggtgcaacagcttgcctatacgaatgatacaacccatatttcataacatcctctttaagcttcatccaatcttcaatgttaggaatatgttgatctccaaacaggcttttaaccttttcatatttagggctataatcaattgtcacgtacttatcaaaatactcgcctgatttgtaagttgatccgtgaaacttgtagtacgtctcccctgtttcttttgcaatttccattgaacgttgcagggagtagaagttaaccatcataaagtatgtatttgcaaagtccttagcttcttcactttcataagcaattttattttgagctaaaaaaccatgtagattcatctgcccaagaccaattgatcgcattagtgtatttgctctcgcaacagctggggcatttacaatgtttgttttccttgtaacagtcgttagtgagtcaattgctattctaaccgtggaagcaattgattgattgctcattacgtttacaatgttcatggatccaagattacatgagatatctaaaccaatttcgtcttcctgatcgtaatctgtataaactgagacttgtgatgcttggagcacctctgaacagttgccagtaacaatcccattgaaaatcagagagtgatagtcttcttgtgttgtatcataaacatcctcaacaccatcttcttcaatactaataatttcagccgtaaaatcatgctttggctttcttgaagaaggttgcaatgtctcagttagcaaattgaatttataaatatcgtattctttcatttcaacaatgctcataaacaactctcttgagtttctatcttgaatactgattttgtgagttggctttacattgtacagcttagaaccacctttcccgtcaggaaggagttcttgtgaacgcttattgttagaatagatcgttgtataaacacccatgtttagtaatagcttctgaacgtcctgaaggctctcatagtgaatggatgttaactcaattgttaatgctttggctttatgatttgcatttacacacccatcagtctggaataaacctgataaataagctgcttgcgtttccttattagcttgaaaaatgaattctgggactcttgttttagtttctttgtccataccgaacttcttcaagatgtcaaataagactgtactattcatgtagagtaaatcttgtttttctggattagccatattaaatgttggagccagtgatgtattgtgtttataagcacgatcgagcttgtgtttttgaataatacggtgaactgcatcagtaactttctgctcaagaacttttttgttatcgtataaataaatcttggcagttttttcagtaatggttccatccccagctataatgcccatgatgtaagcaagatctggctcatgaatgtcgccgtatgctccctcacctgattgaactaataatttatcgcccgtttttagctgattcaattggagcttttgaatttcaccgtcccttttcacatagaatttgtgccactcagttgtccttatttcatatccttgcttcgttttgactttaaatatttccgcatcttttttagtcaattgcattggaattgcatctactattgaagtacctttgctgccaactgcaaaatcttttgttctattatcaatgaccactttaagctcattctgctttttgtaaagatcagctgctttttcatatccattctcagttaaaagaagtgtttctccagtaacgcacaaattagaaaacttcacttttgaaatatgttcatttggatgcactttatttacattgtcagcaaacatgatatacggatatcctgattcgcttcttagaatggccaattgctctaacagttttcgagcatttccctttgcttttctaactttagggttttcaacaagctcatcatacattttattgatttccatctcatcaagatacttcccatattctttgtagactgagtgaggatagaacatgtaaaaatccttatcttctcttgccaattcaataaatttatcagggagaactacaccaatagacagtgttttaactcggacatcttcatctgctgagatttttttggtatcaaggacgtctgtgatgtctgggtggaatacgcttagataagctgctccagacccttgtctttgtcccatctgatctgcatatctaaaagcattatccaatagcttcataacacctacgacacctttagttgcattctctacgtctttaatcgcttcacccttggctcgtaatttgcttaggtttaatgctacaccaccgcctaatttagacagctgcattgaaatgtcaattgcacgagagatgtcattcaaactgtctcccacttcaagtaggaagcaacttaccatttcacctcttcgcttacgtcctgcattaaggaaagtaggcgttgccggctgatactcttgtttcatcatggcgtgtacttcctcaatagccttttcataatcaccatctgcacaatataaagctacaattgagacacgatcctcatatctctccaatatctttgttttgtcgtttgtcttcaatgcatagtcattgtagaacttaaaggcactcatgaaagaagggaatctgaatttgtaactgtaagcaatcttaaaaatcgatttaatctgctcaaatgtgtattcgcttaagaattcttcttcgtaataatcatttttagtcagataatccagtttctcttttaagtcatggaaaaagactgtgttctgattaatgtaatcaacaaagtagctgtgtactgcctccttatccttctcaaattgaaacttaccgtctttctgaatcatgatctcattattgagcttaatccactttggtattgtgtttgtcaataagttgtacctcccgattaatcttctgcaaatcttgttttgttccgcttagttcaaactttaataacaatggtacgtggaacattgctgagagcttgtccccagctaaaccatagttatcaccccaaaccttgttaccactcacaacaactccttttattttatttttattcttaataataaagtttaaagtcctttcaggtacttccccaaagcctatcgtatatgtaatatgtataaattcttcttcaatgattaagtcatctgtaatttcaatgacatcgaagtttaactccctttgtaaagcttgagcaaaccttttcacattgcctgtcttgctttcatatgtaataatcaatattctttatattctccgttaaccaaactgttggtggttgtttctgcttcattttcagcatgatgaaaagcttcagacatttctaaattaatgtctcccatttcagcatagcctttggccatttgagcttcataatctgataactctgtcattggtactggaatgtagttatccttctgctcttgtgtgataaccatttgatccccttcaagattagtcgcaatcagctctccttttaaagcagtgtatgaaccaccattcttcatatgtacttgcgtattttcttttgcttcatccaaggttacaaagtgactgcgcttaacgtataactgtttagcagctcccattccacaactcccttttctttattttttgtttttatctttgtcatgtcttacgtctaacttatccatatcatttagaatatggtcaataacaacatcgctgaacttaccgtagaccttatatccaattaatttgcttctcaaatctctccactttcttgctgcactcattttgcttccccttcctttgaaactgtgattttatctagaaataactgtagcctgttttggtttatcaatgtatggatcaatcgttttactcaaaacatactccagagttttgtatctaccttccttattttttttggaaacatagaagttcgccaagttcatccagactaatgctgaaaggatcattacctaccttttctttaaatgcagttaattcactgaatttttctttgaattctataagttgctcttgattcaaactatcgattttatatccaagcatttcaacaagttcaagtcttctgtgttcaattagttcccttaattttgatctcaaacccaagaacttttcgtcttttctctgctcagcaataaactctctaatattcattttcatcatcctttactttactctcaaagtttcttatctataatacctttaatgctttttaatgtttgcttgtactcgctatccaagccacttacatcaagatttgttgagattcgatagtttcctgagttgtcatacattgtgatgaaagcctcagtgtcatcttctttagcgctaaacgtgatatcatgaacgtcaacctgatctgcaccgttttcttgctttagttcttcaacatagtctggctgcatcatgttgaataactctttaactgtggtgaattttacttgttctaataagctatcttctttgtattcaaatgtctcaaaataaagattgaatgttatatagccttctacaagatttccatacttagtgtattccatcctatctactctccttttctgatttctcttacttcatgcggcactccactttcttcttgagcatacacagcatcattatgagcctcaatagcgtcatcataagtgttaacaagtgttcccatgcaataaagtccgtattttttattcattttcatcatcctttcgtggtctttgaagtttattgatactttcatacagcttcatgagctcatttaatcttatttccacttcttcaaaatcatatcgactttgaagaaacaacactctttcccttaatagaagcaacacttcactgatagctttatcatgaccaattatttctgcaattgaatttgtttcattaatcgattccatgatatatttgccctgtctttgacttattcccagatgaattcacctccttgtatttttatccgttaaagtaaactgccctcgattagtaataccatttcttcatcattagaaatctcttcaagaacctgcttaaatggcataagctcttcaccttctcccggaacccttccttgtcgtattgccgcataaacttgtccaacttcagtcatctcatcacttaattccccgtcatcatcagcaacttcttttgtatataacttcattgccttttcttttgagtaagctttaattaacgcataatagggatcgctcacttcgaagtacttcataacgggcttctcaactcccaattcctcaacgtaatcgcctttgatttttacatcatcaacaccgttttcgagtaaattatctacgatatcctttcctagctgttctaacgcagccccttgaacagattcactttcgttattaaatccctcatgagcgtaacaagttgcttttatttcaaaaactgctgctttaatccccatagccaattctccttttattttacttttgtgaatctcttgatctctttcccatcaataatcacttttccaaagaacaccgtcttggccttcatatgtaaccaacttttcttctgtttcagtgtgaactgcttctccaataaccatatataaaccgcctttataatgtctatcctgacaaccgataaaacaaatgtgtctattgtagctttcctccttaaacttcatctaaatgaaacacaagaacatttttatatggatctaattgaatttcattgcttgtttcttcaccatcaattctgaattgaattggtgtatctccgttaaaatcaagttggtcttgtagcgctttaattacatcgctaactttaggattaattaatttcccattgatctcatcataagccatagctattcctccttttctctctaaaatcatccttttattacgacctacagaactgtgaattcaattttaattaaatcagaagaaatgtcagttaaccttttccttgtcctaatagtctttgttttgccttgacaagttgtgatttctaaaatcgtaggatcttctatatgaatactagagtcacttggtttaagatcatctttatttgcaatctctaagaatacactcctttctccttcatacatttcacaatcatcaaaagtccctaccaatgttttttcatttggaagaaaaacgttttcagtcgttttgtacagttttacatttctcattttcattcttcttcatcctttcaataaaataaaactttcatttagacttcaatcaactgattggtatctaacctttggataggttgttttcatataaacttttttcatgcacaatgggcattgaaacggatatttcggtgggtttgatgtgagcatcatatttgaaaacacaagctctggagcttcttcgcattcatcacaatgtaacgtctctctaaaaactttaacttgctgcgatttaatcatattcagattcctccttcgttaaataaacaatgtactgacatacagaacaatcaatgcaaaagctgaatgaagtaaagacttaccggctttcttgaaaatgttctcatctttttcctgatctgaccgttttacacctttgacaaatacgttgagtaaaacaccaatcacaaatgcatgaggtaaagtgatatgggtattttgaatgttgtatgtatcaataagcaatgggtttaacacatgattcaatccataatagacaactagtgacatagtcactgcttcaacaaaaatgagtaaccccactacaatcagagaacctgatccgataaagaaaccgttccaaatatcttttgtatccttattcaataaatatctctcctttagtcttttttagtgattagcctcttccaccaggaagttttacgtttcttttcttgctctttaaagcgttcatagtcttgtttaacttgctgattccatttctctattttttcttgtttttgaattgctttttcaaggctctctttatcctcaattgttttaatgaccttgtcagtctgatatgtccattcattttttgtgttgcgttgcctgtctgttacgactacgtattcgttaaaccctgggatatacactttccctccgacttcaattgggtctaagtcgatgttcccttcaaaaaatgtctgatactcacattgctgctcgattgggacaagggcatcacacaagcctaatgtccaacttttcttaattaccttcccttcaaatgttgctttatgtcgtcccacttattcacctcctactgttgcatctctttcttaaaagcatgtttcaaatgttgccaaaatgatatccttttatttcctagctgattatcatgcttttcttttactttactttcgtctaaatactcccttaattgtttttcagcttgaattttactctccttattctcgactgtgctaatgacataatcagtgaagtaaatccatcccccatcaagcattttgacctttttttctatatgaacattttcatcaagttcatttatgtaaagagtgtcaccacagttaacttcaaaattaatttcatcctcataaaaagtttcagtagatatatctaaatactcgtggtcaatagctggtggctttcgtttcgcatggacgccatgaaaacacgatggatatgccctgaaaaggtaaatcttttctattttcttgcctttaaatactgctctacacttctccatgttagtttcttccttctcacatttcattaaatgccgttattgccaccaacagttgctttgcctcaacttctgctatttgatctccaatttgaacctttacccatgtatctggataatcaatactcttagttgccaggagtttcagagtttttctgtttactcctctcaatgtgaattcggatgtaatgtctctcatgtttttctcctttctttataaaaattgaattttaacctaatttctccaagataattttaagataatctttgaagtcaatagctacagcttcttcaccttctacacgtttctcatctcttacgccaaaaaaccatctatcacctacccactggcttgcagttatattatttctcccgaacacatcatggcctttgaaaggatttgcctcttctattttctctagcatagaccttatgtctgtgaaatacttagaacgttttttaaatgcatagaagccagcttttgtggggtttttcaccacttcatctttaaagaagtcatatgcttctgttcctgcgcgtactccgaaatactcggaatgatagaacgaaaaaccattcttaattccgtatgttgcttcgaattcatcaaagaatttgttaatatcttctcttcgtttcttctcagttttataccaattgctttcttgcttaatctcataaattggtgcatctaatgtttccatggctctatgctccttttttgtttatcacctaaagacatcatttgttccaatttgtcgcatactgcgctttcccaggaaatcatttatatttcctttcactatttcccttcatcttgttcatatcactgtaagaataaatccgataaggagcgagcaagctcccattaagaaaacagtgagataaaatggcaaggcttctttaaagtttttattctcaactaaacttgtaagtccattacctatgaatattgaaccgaacaagattagtcccagcaccaaatatgacatttcattctcccttcttataatggactagattattactcatggtattcatacgcctcttgaactgcattaaagtcttcattatctaaaacatcctttgctacttggcaccaatatcctaaatcactaaccgcttcaactagttcattaattgcttgatcctgagtaattggttttgaatctaatatccagcctccattaacagttctttctaacgtatgagcaccttttttatgtaaacaaactttcaatttatccatttagcatctctccattctcgataaaaggaatattttatttttactcttaaagtaactgcaagtaatccaatgtcttttctaatttcatgtctttacaattttcaatgcattctttcttgattgcttctccgcattctttatgtaccgcgaattccttatattctttgttgtcagctattcttatgtaataaacgatttcgccaatgtgatccttgcatttaacacactccaatgcatcacctcgattcttatatttctaatatactcgcattctctcaaacaatcaacaactattttatttttattcttaaaaagtttcttttaaatttcttagctttactgttgctgccaaaatatccgaatcacacctcttccatatacggttatcctctggccttaaattgttctctaaataaacccaaagcttatctaatatttcctcaatctcatcaacgtcattattaatgatatccctggcagtatccctaattatccgatacctcctctacgagaatatgattatagctttcccgttgtcattctttatgtacggcgaatgttttctctgaaggcaatttgtccccctaccttccccaatgctcacgttataaacagtctttaccttatgtatgtctaatgccttccgtttagcctcttctgtagacattgcttcaattaccaaagacgcgttttcgcctttgtgatctttacatctaacatagtaccttttcaataaacatccctttatcctttcttgttatcttgttgtattaatcttcttttagataagacttgaagaactcatctaggtttgcagcaatcgctccagcaacttctgcacaatgagcatgactcttttcttgagatcttaaaaactcaactgcagacttagcaatggcttttattttcccctcgtctaatttgccgcttcttacttcatctttaattttttcggcttcctcttttaagctttctgggtagttcactacagactccacctcttatattttatttttactctttaaaagacaaattttatagcgatttatataaaggaaaaacagtcctgtcaacctcatctagataaacctctatatctctcctatctagattccagaagacatttttcacaataaagcacctcttatcatttatatctgatgacagatctcctcctacaatatagtcacctgtacgaggcaccattgactctaatcttaggtggtttccttccccatccttactatatgtaagctcactcaaagaactgccggttttacaatcattaaaaataactaaccatctaacttccatttcacaccctcatttcgataaaattgatcttttatttagatcaccaaccgtaaaataatattgtctctttctcaaaatctatggtttttaataatctgaccagctcaaaaatactgtattcatatttccaagaagatgttagccatgaatcattaatatccgtatttaacgcccatcctctagtccactcagataagttgttcttaatatgctgctcttgttttactgaagcagttccatttttatcatcaataagcaagttctcgtacattgcaatgactttgtttttataaatttcaatagcttcttcaagcccttctttaccaacaatatatggaacataatccgataattcattcataacttcttctctttcaaagagagggtgtccctttgaataaatgcggtcggctgtatcatcccaatacaacttcccaaactcccaaatttcctctttaggcaggttacctatatagaaataaccttcttctcctattgcaccgaactttttggacaattcattgtaattcattgattttatttcgtttacaagttccttgctgattttatacatataatgtctataacccattacagtctcccctttctctttaaaagagatattttaaacagtttcacaaacacttcacacatttcaaatatttaacatgctagactggagatgtaatcacaatcaaaacctaggaggtaattcttatgaaaaagttttacaaaggattgattgtttctgctctattgcttacagcactagcactccctgcattcacatcacaggcttctgctttaacccctgtcaaatcaattgatcaagttaagcagctaggtgatccgcttggtacagttgattttcacatgctgaggaattctaacgtatctctattaaaaggctacacccgatgggaaattgtatctggaagcaaccttataagcattagttccagtggtgtcgtatcctctcattcaactttgggcacagcattggtttacgcgtatgacattaacgacaattatgtgatttataaaattacagtagaagcacgttagtttactaaggagtgttaattcactccttttaactttattttcactctaaatataatgatattttaaagtaatttccgttcaatctcctcccaattcataacacgaataaatctattgtcattcctgttatgcggtgcatcaaatagtatcttcattccatcaaatgtttctaagttatgcactccgtcatcaatcatgatgtctgctttaattatgtttttattgccacaaagcacaacattactatgtggaatatatggaaaatgctctgtgagccattctaactttgctttaagggattctggatggtttgttgctgtagtaacaacatatacttcatatttcttcgccagctccttaactgctctctgacttccttctataacatccagatttctgaataattcgtaatccaaatgcctgtaaacattgttttgggtatttgaatatttgctaatatcccagcacagtatatcttcctcttttagaaaaggatcatcataggtgttaatgtaggctacccaatcacttagtaaatcggctaaaacttgatccatgtcaattgcaattactttcttcataaatcaccccatccgttaaaaagattatgcctttagcaatttcttcgctagaccactgttctgtatcccatgaatatgtatgtaacccaacatcgctcattacttctctgtataatcctaataccggctcaatatcacgatcatttatgtattcgtcaccacgttcaagtaaacgctgcttaataactttcggatcagcatgtaagtagatcaccttggctttatccctaatcttctcctcgatgaccctttgttgctcttccgttaagattgagtaatccttgaacttcttcgcataaactaaatttgaatatatgtatcggtcaataattacattgtcctcatcagccagcttgctaaagtgttcaaacagcttctcattaccgctcttagctaattcaaagctggatccttttattaccggatatccgagttctttgcttagcttatctgctactgttgatttgtagcagcagtcagtgccttctaaaataatcatcgtcatttatcttccacccttcttacattgctgaagccaatcactctatatgagccgtctggatactcaacttctaattgctcatgtcctttatcaacttgtgcaacaacaccaatctctcctgtgaaaccagcaatcaccttctctccctttttaaacatacaatcaacctcctttagctggatttaattcatgctccttgaagaatgtaatatcacctgtttcatcactgactgcgtaatcatatgtggcagagtgtagcagctcaataattttcccttcccgtccaacatgatgaggacaagcgttctttgcattctcatttatgatgacttttaacccttctggataagaccaaaacttcggcaattaatcgcctcctaactaataattgagattgtccccttttgcttgccaaaattaattgcgtcacgctcggttgctacaagcaagtccactttatttccaacaattgctcctccagtatcaattgcaattgctttgaactttttcccaccaatgcttacttcaactattgaattcaagggaataacactagggtcggttgcaataacacgataccctttgtaatagattgattgagtgacatcaacacctgttctagttgttcctgtgcatccttcttggcagtgggcaatataagcactcagcttaacctggatggttttctttgcggccggtggcttgttttctttttctttaatactaattttatttttactcttaaaaagtttatgctttaccgtctcacctcccttcctgtgcctttttttactttgcttaggtttaatgagttttgctgagataatcttctctgtatgcctttttaattgctgttctttgttagtttgagcttttttaaatagccgtaagacaatattctcacttgatggtatcctaatctgtctaggcttcttataaaatgattcttttattgagtcttcatttccctctgttttatgtaaatgttgctcataacttatgtaagaaaaagtggttaagggaatcaaaatcatcataccataaacagacttgaaaatgtgtgttttaattttatttttactcttaatggcgatgcatatcacttctccttctttgttttctttctattcgatattcctaaataatcatttattcgttttttggctatctctatgtaatattccttatcaagataatcaggaacttttaaatcaataacgttatcattatttataaagcagcgcggtggagtatttccgattttttcaattcgttcttctgttttaaccttgaaaacacctttagcatcttcatcattagaagcaaaaactcttaaaactttttcaggtagcctttcttctccatagagagcgtacatatatttgtttgaaacctttgatatcttttgaaattctcttaactgatcacattcattgatggttttttcaactggaatatcttttgtaaaatactcaatcatagctttattaacaattggtaagtcataatccaggttgtttagttttttaacataagcacctttagatttatacttctggtctttatcaatgattatatagttgtttacatccttctgataaatcttctcataaacatcccactctaaatctaatcgtgttctggtttcccactccttcgccacttccttaattaaatcaatatcagattctttctcaactttcataaacaacccatcagtatttgactgaatcagtttacaatacggttcaattttctcgatcaaatctaataacaacagctgcccggctaaacatacgttattggccattaacgggtcataaagtggattatactgatctttcattgctccatacgttgagtttaggacgatcttgtagggagcctgcttaggatcttttttgcgttttaattctaaccgtgtatctctgatttcagtatatttcaaagggtttttcacgttacgactgatgtaatcatattcaatcatgattgaaggatatagagatgcaacatcacaacataaaattatcccttcatctttatactttggtaatgccccatgtaaacctccccaggcaaaaatatgaggtacacctgcaacatcaacctttaagttttttttataatctagattttcaggatttctataccaatcaacaatgtgtttgtatttttcaatttttaatgtattaggaaatctaagttcaaactcatctcccctgtttccttgcttttcagcccccaagataaatgcagataattgggcttttgtctttgtaaacatagacatttctaaatcaaaggcttcaattaaagccaattgactttcgaattcctcttttttattatcaaacacttcaattgtttgtttcacatcgtgaatacagtactcaacaacttccttaatttctttttctgttaatgctcttgcgatatcaaatggtactgatgactccttaatccttgaacccataaagccttctagctgctttaagctgtggaaaccagttgttatgtcaaagttattcagtgggatcttataaccttctctaacaacattaaatccctttacattatcattaataattcttgaactaatataataaggattcattcctaacaggattccctttaaaatgtattggtcgtacattctagagttgtaaccaatccaaatatcatctttaaacatcttatagaatcgtttcagttcatcaacatcatctacaataaccttaccctttttagtatcataatcgatcagcacaaccatccagttatgtttaaaaacttcaaagtcatagaatatcttcctcatcattaccccctaagaaaataggttatcaaacaaatcggtcttatcctttttcttaaatttatttgatgatttatttaaaaaatccttataaaacttgcatgtttttcggtgaccacataagacactgcaataaaaggaattgtatttatctattttcactggttcccattgggtttcatcttcacggtctttattttcaatctttttaacagtaccagtaatataatctttcagttcattaattttctcttcagtaacttcgtattcaactaaacaatcttcaagccaatacttatttctaatctcggcaggtaagcagtcaatgctattttcttttactgcgttatctaacaataggtcaatttcgaaatcatcatactccaaagtgcgcatctctttttctagtttcattcgtatttcctttacccacttacctctgttacacattttctttttcactttggtttttccttgggtacatacataaacgtatttcaccatgaaccatagtattttatctacttttaagtcagttgtttgctccaatgcaagcttgtacatcaatagctgtcttcctgcttcatttaatttcttgccggcaaacttacttgatgtcttccagtcataaatactaacgtatggttttcctttttcactgggaaggattgcatctacatatccttgaagataaatcccatctgatatttcaaatacaagcagcttctctaaaaccattttgctgtcaattttattaaaattgtttaggaaatgaccaatgtctgctttccagctgtctccgattgagtcactcggaaagttgactccattcagctctaattcaattaatctattttcaaatccctttttaaattcaccaatgtctaattcatttttataaatctgttcaattccgttatgtaattcagaacccataagggtgtaaatattatctatgcctttctttttcaaaacgtatgtattgtagtattcatattcacagttattaaaggttccaagctttgaaaaggaataaatgtttttcccttgttgtctcaattcatttaatgtttctttcaatcaatcatctccttttcatatccaaactgtacagtctctgattagacggtgtagagtgcttttatcaaggtctgctggtgccatttttgatcccttaggcagatacttgttttcacgatcaaatatgtacccaacttcattttcaaagaaattttcaaactttaggctgttggcaatttctacgctatgttcttcacctaatccttcatccatcatgactaatgactttttcggaaacattgattttatgtgatttgcttgaatttcacttaaaaagctgcctcctaaagaaactccaacattcaatcccttacttgctaaggccattgaatgtttttcggattccccgatcataacaatgctcttttctctaattgaactgtaattttcaacaaacccgtatagcgttttggacttgggaaatgaaataataggcagccattttgtttcctcatcattaacttccttcttattaagacgccccattacaccacacaattcaccactaagagatttccatggcaccgttattcttccggaaacactatcgtaaccaacctggaacaaagattgagttaaaggtaatattccatcctcataaaacaacttatttggaacagatacaaattgatctaaaatgtcatcggaatacgtttctagatccaaatccattggattacttagtcttcttatattcttataaaaacctccgaatggtaactcaggtggtttatattcttcttcacttttataatcaactatttcagatatccttttgattgttttgggaaaagataaacccaatttattttgaacaagtgttatcaagtcaccttttaagttggttgaaaaacaggttgcacctaaagtggttttatttacttttactgaagtcggatttcttcctttttttctcgcacatctgtactcattcccgcgttcatcaacattgtaaaaccccgtctgttctaaaataagtactatgtactctggcttttcaataatgtgattcttaagatcatatacgtccatgatttcaccgtcccttggtaatcatgtccgctctgtagttctctgatgtttaggagtacaataaccgagctcattccatttattccatgcaccgtcaaattggtataacaacactgtatcgccttcgtcattccgtgtcttattcaaaaagaataatctatacttcttatttgggtctaactgaatttcttctttaatgtttgtaaattttcccgacgagtcttttttgaatctatagggtttaacatcgaattttcctcctgggaattcatcctcccataaaggtcttgttagaactaactctgaaacaatctccttaactgctttggcatttgataaacaagacgctgttagatatctcgtattctccatataaatggccaactgcattgtaatgatgatgcaaatatcctctttttccgcaacttgcaataactgttttgaggcttcaattagctcacctgttacattggttgaagccgcatcttcagctttaaatgtatcgtaaagcatataaccgaagccttgttttgccattcttctcattattctctttacatcattaatgctgtaatcatatatcttggcaaatttgatacgccccttgtaatgcttctcataatattcaattgccttttgtaacatttccttttgctcatgctttaggttgcccattttttgtttctttcttggcaaaccataataaccaagtttatgacttaaaattgttgccataaaaatatgttgccaagcccttttattcatttcattggcgataattgttaccttttcaccctgatctaaaattgacatgatataagaagaaacacaaaaacttgttttccctgtcccactaaatccagcaaaaatttgaacattagatttatgaagtccaagcgtgtgataattcaataatggacatgcagctgaatagcttaatcccatttcttccccgttttcaattgattcgacaaactcttcattcaaatcaagatcctcaattttcactcctgaaccgcgacctagaaaaacattatctaattgaaattcaaagtaactgtacaattgttgactcgtcatcttcttgaatttatcaagctcgttcgaaacattgaatcccttatcatgaagctttagtatcatgttaaatttaattagttcatcatagtatgtctcaacattttcatcgtttagtacgtgcttgagttcatcaatggttttcattccacctcgccgaataaaaccattttttaatgtttctttaccttctatgtagctgaaaacactcgcatcatcaaagctcttataattcatgttgctcagttctaaacctagagagtaataaaatttcccgtcttctgttagaaaatctctatccgccctcacgtggtctttataatcctcatacaaatcagggtttttccataaacaaaatataaagcttccttcaatttgtcccctgttttcaactaattcctttggataagaatctaagttgttcaatactcgtcctccccatccagaaactctgttatattttttggtgaattgttttgttttaaagatgtggaatcaacgatattagtttgatttacaattgcaatatcaagattatgatttttttcaatcattctctgattttgttcatgcagccattccttataaacatcattgatgttactttcaacaatcttaaaaatatagctaatcatcccatactcgttgtaaaactctttattagttaaccaatattgaattgtttgttggttcttctcaaagcaaatttgtatcacttcataatcataaaatctttttagttcagctatcttttttagaaaaattggaggaatgacttgaccctctctataattcaagacatctttcgctatgtagtttaagaggttttttcgtttcaccttatcattgatataggtttcatattcatccttagtacagtagtatttatttttccccttatcatcagaaaccctgaaaaaagtatcaacagttccattagctttacatatttgacatacacatcttctggccaagaataccctctcctattgataagggggagactccccctcttttccttcagttagataatgcttcgactatcttctcgaatgctgtagttggtacaatgtctacacctttaaaatctttcatattaaattgatccataattttcttcatttcacccttagcttcggcagttgcattagggaatagtgtcttaatctcttcggccaacctctcattctcttctttatcaataaaagatgagttgttaacttcgttgtgaatttgaatttctttaatttgctcttgttcttttctttcttcttcaatgttatttgtattatttttttgtttatcaaaagccacatggatagcttgttcaattgctttaataaattcattcggatctaatggaattgatggtgtgatatcggagaatcttgactttgaatcaatattaaagttgtcatctctaaaagtgatgattcttgattcatcaacaactgttcccactgttttgtcaggcccaattttttgttttactgttttcttttcaatcgaccgattaatagatgctactcctaaaacgtgcagcttggttttaatcgcattgaagtatttatgtgtcatattggttgtcagcatgtcgtattccaaacccgtaactacgtctgtcattgttcttttcttcgtatgacctaaaataaacatgctaataccgacctttttaagttcccacatcttctcaagaattaactcaataactttgtcttctcctgcctggaaaccaccaaacgctgctttaattgtattcactcttttttcaggattagctttattatgtagtcgaataacttctggttctgtaattttaattaactcatcaaatgtgtcatatactaaaacctttaaatctgcataatctgttgttctgtttttaataatatctttagtaatttcattaaaggttgtccaatcaggaacatcttcataggaggcatttgggatggcatcgatgccatcctctttaccaatattcaagattatatacccatctgctccgactaattcttcgcaaacttctttagctaaagttgttttaccgatccccgattcaccaataattccagtgttataatcgagaggattaactttaattttattctttttaccaaattttcttgccatatggataaacatctccttattgtttttaaataaatgtcagttaggtcttttcaaatcaagcaaataaatcatcaaatgcattatctttttcttcttcagtcactttaggttcttctttttctacgggtggtgtagaattttgaatctgttgtggaatatatgtaagatcttcaatttcatatgtagatgttgcagcaccttctgtaaaatcattagaatcattaatcttttttaaaataggttttaaaagtctattttcttcacgattttcgcccaatagccctcctttaggtttaaagtcatctagtgtgtttaaacctaaagcaatcatttccttttgactttccgtgagttcctcttcggtaaactcaatctcatcagcacccctgaaaatattcacaacccattgaaggtgatatacttcatcattttcaactttaaagaagtttttcaagagatttaatcgtttcatatgtaaatcattttcaaagtccaatttttgtgcattaatgactaattgctgaggaaaaaatcgatctttttttgcctgattatcatagctaagcacatatgcatcaacaaagtaccttttttcttcttcaaatgacgattcatctaaagattcacttgtgaaaaatacatccattgtggctcttagttgagatggtgtatcactacttacaatttcaatggttttgattttgaactttctaaaattccgtccattccatgaattgtattcaatattacctgtaattttaaatttattgtctttatgcttttcgagattttgggataagtactgaatagcatcgtattcatgaatgaattctgcaccgtttatgtttaattgtttatattctcccttgagagtagataaagttttattttcttcttcagtaagagagtctttcatttccaaccctctaattttaaacttcaattcatttaatttggtttttgttgactcatcgtttaagttaattaggatcttagaaaaatcagcaaccatgtttactgtttcttctttcaaccgatcttcccatggaatttcgagtcttgatcctttttcattttctgtacccttgctgaatgaaaacactttattttgtttgctttttgagtaaccaccttcaatctcaacaaaaacactgtttgtttttgactcttgaactgcgaagcttaatctttccttaacccatccgctgtcatattccttaatttcatggaatttctctttattgtttgaaataaataggttaccgataaattcaaatgtattataaagtttgctcaatataacgcctccgttaatattatattttatttttattcttaaaatgcctataatgagacttgctactaaacttacaatccttgataccaagtagcttgtttaattctatgtatctcttttttggaaagtcccaaggttcaggatcaccttttacattttcaatccttattactgttccatgtcgaattgtgatctttaagtttccatatgagtatgttttagaaaaaagacctcttttaattcctcttggtttaaattcctttaccaacatcacattcctggttaactttcttcttgcttggtcttcgtcaatgtcgtaattccttttgacatcatttttgtaggtatgtaaggcttcgacagatactttcagtatctttaattcctttttcatctctttcctcctttctctctttgggataacttaatcttacatcaccaaaacggatcggtcaataactattttatttttattctcaaaagttttaaaaagagttgagctactatctgcagctcgacaaagtgcttttatttagctggaaaagttgctaatccttttaaggttgttatcaatatgttttaataaatgaagtttttcattaaaattcgtatattcctctttagtgattttctttgctaattggtattgacttgaatctaattgaactttatgaccgagtttatctttaatgattacatgcttaacattaaatatcctgtatacttcataaaaagagttgatatctagatcatcatatttatttgcgctattgccactttctttaattctattgccatcaatgtctacaggtcgtgtatcgattggtttcacaaaatcacccaatcgaggccttctattaagagttttaaagtaaaccgtttcaccgtactcgttttttgctgttaagaaattcatcagtttctcctttatcgacgatattttttagaatacctcataaaagaagagccgcttaaatagcaactcaaaatgtttatcttattagcctcccactctaactcccatgactcagcctccaatagaattgatggacataataccactcctttattaattcaattataccatttacaaaggagtttgaataatcaaataacctcactccaagaccacatgttcattgtttgcagcgtaaacccatcaggaagctttttcattttaacattcacattgtatctcttcccagtagtcttatggatcacagcaagttcttcaccatcatagaaccgcacaattgcttcattaaattcaattggctgatcaaccacataaccttctttaagcgctctgatatacagataagggtctgtcttataaagctcatatagtctattaccaaagtcttcgtgtttatctctaagcagattaaaattaatcagggatatgtacagtttttcagatatgttcagcttgttcttgaaataccggattgcttcatcttgttctttggttaaaatattggccatatatccatctcctaaacttgttaaaactacagttttatttagaccacaatatctccttctgcagtcttcagtgttccactgtcatatgtgttataaattaaggttgtattctttgctttatctgtgcaatatgggtgggataataacttgccaccaattccgcgcacatcgtttcttacgagacgtaccttgtttgtattctccaaataaacaccatatccttggtctgctgaacgattgaacatgatctcattatcctttaatatatgttctgaaccaccagtcagttggatggcgattaatgatttacagaaataaacctgattctcactaatctggcaactgtatttctcaggggtgcctttaattgcaacattcctaggctcatgaatttcatttcgatgcagtgagacagaagagtctttatcccaaaagatgccgtatccactcccacttaacaacaagtcatttccctttaaacgaactgactgagacctttcgcaataaattccaccatatacattagcaaactcattattaacgagactgattcgggtagagtccattatctttgcagcataagacgagctcgttccttttcctttggtattcacaaccttaatatcatttgagtttctaacctggacttgaacacaatcactgttttctatcctgttgtccgtaattaaaaagtcctctgcttgatgtgttgcaatagggcatgcttttattttttcaaaagtattatttgatactgtgccaccctttcctcttacacaaatgcccacttcaaagccactaatcgtattgccatcaatttgaactctgtttccagactcagtacttgaaacacctaccgagtcaattccataagtcttaatttcattttcattgatgatcttgttatttttgatactgacatccgtgctatatccataggaaataacatggtcgctgtagtttccttcaataattaccttgccgcttgtgtgagctgtaacagatccacgtccattgtttttaaatctgcagtttcgcacagttaatttatacgggtgatcgtatttaattccgttttctccaaagccctctaaatcaattcctaattgtggcccaattgtatctcctccagcttcctctatatcacagtcatcgacaagaagaccttcacaaccattggtagccagattatttcttcttcctcttaaaagcgtacactttcgaacggttacattctttgaaggcgtatatgttcctgaagtgttcatcattccatcagccgctatccaaatgttgtctccaatacagtcagaaacttgtacattttcaattagcacattgctacttccattaacatggataccaaagccccattcatgcgtcttcttaattgaggtaatttttgaataatcatgctcatgtcgatccccaataatttgaccgccacgaatcgtaacattacttgcttggccgatataaaaacaggagtaaccctgataatcatttggctgcactttaaatatagcctctggatgaagtattagctcaatattcgaaggaacattgatacctccaccgaattcaggtaaccgctttgacgtattcactgcatcaattaggtagataccttttggaacatatactttatagaatgattttgagcatgcatactctaaagctcggtttaatccttctgttgtttcaattgcatttgaccctttatcatcaattccccaatccagagcatcaacaaaatagtataagggctgttgcatgttcatgttgtcaaacccttcccttctacattttcattgagaaaccctgatagagtgtcaatgaagttataaaaagtctcatttcttgtaccagagcgtcctttcagagaaaaggtgttgaacattgatttgcgtagtccagtgctcaattccagttgaatgctctttcctgttttatttttattggccacgttatttggactgctaccggatagcctcgtaccctcatctagaagctctgcagagtagccggcattatttaatgtacttgttatcgcttcagctttgtcccggtctgtgccgccaactagaacatgttgatcattacttgcataaccgtgaagtgacaatgtgaactcatgccccttcaacatttcaagtgcttgtggttcatcaaaattcgtactggttaaatgcaaatcaaaggctcctggtgtctttaaagcttcaaaaagatatgtagagtatgtttcgcttaattcctttgcaagctcgcttgttcccccttctatgccacctccatggggagcaagaattaatacatcagtgtcttgctcttttgagaacacgctaaaattgaacggtgattcattcgctttaagctcttcaaagttccgatacttgtccgctgctaagatactgattggattcatgaacgaaaccaatgctgtcaccaatactggaaaagacttcttttctgtgatatactttaatagcttcgtaaccttgcgaagtgtgcagattagagtgtaccgtccaaagtctctcttttctgctcctttagtcttttttagcaattcctctattttgtttttaatcctcaacaattaataaccactcctttttatttttgttttatttttaaaactcaaatcatataaatcgatcacatcgttatcacccccttaaataaaaaattacttttaactgatttgtcttaactgttcactcatataatcaacccattcagtaaaagcactaattataggttgtctattgcctgaatctgcccaccctgcgaaaccaataaaaccatctggattaaaactaattgcttctctttgagtaaaatagtgactgtttatgtaaagataacaactttttaaagttccatttgttttgtatttgctttttattttctgactcattctcattgtatcaacagacattgtatgtgctttaactgcctgtttaacatgcttattgagtagcataactaaagcacaaatatctccctccgtaatgtcttcataactaagtcccttttgcacaaaataatttcttgcttcttctgaagtcatttaaacatctccctatctggttaaatatcgtttttatttagactctataagctcaggatcttcgtaaatgttgccgatgacttctgctttgctgcatctgcagccagtatcgacatcacgagtattgtccacataagcaaacagtggcctttctccgatatagaagcccgcataatcttcccgatactcaacttctaagtattcatcaatatctttaggtggtttgcctgaaccgtacatgacaaccgtgactgttctttttaaaatatccccctcataaatctctcggccgtttttgtcttttaatccggtgtattgcccaactgtttccggcctgacactgtaagcaaatggaacaccagctttattagagatataagaaccaggatcaatacccatactcttgattctttgcttaatgattgataaattgccgtaataccattctccgttgatgcccattcctcgaaacttgatttctctcattcttccgcctccatttattatttagattcttttcttacccattttctaaccttaacttccttaagctcaacttcaaaacactcaacctggtcatcgtattcccatggtctctcctcttgtaactctgtagcgccttccctgtaagttgtctcataaaacttgtcttgatatgcaaacacaatacgataatgaatactccacctagacgtatcagtgatttcttctaaaattgaggattcaggcagccgcaattcatttaccatgtaatctttgtccaatttaattttcacttaagataacccctcttccttcgcagcatttacattcgactaaaggctcattaattttatccattagatcatctagaaatttcttaatattgccctttaaatcctcaacatctttgccactaaacggttctacaattgggtagctctgataggctttaggtgcaacattgtaaatttcaacttcccgctttgtttgaaatcttttctcaagtttaggctttctacgtttgtacattgtatttagatcaactacgtactcttgaggtttgcaaagctccaaaactttgaccacagttaaacagaaatcataatcactcgtgattcttgcaaacttagggtttatattggcttttatatggtttctgataatcttatagctttcttctcgggacaagtaacacggctttgtttcaagaagcattggatgagtttgaattctatccagtaagttataattcaagttaaaattatggctttgcaacttaagttctccgtcaatttcttcaattacattcatttcaaactcaattttttgattctgttgcgggacttcttcaaattttaaattatatagacccttcacttcatagtattcactgtcttcacctatgtaagaagttttaattacttgtggcgtcaaatcagtttcctggaacccctcttttaattcatacctatgattgatttttttagcaggcatttgtttttcaataacacttggctccttatcaagcttaaaccagtctgatttatacgtttcagttgctcgtttcccatcgaaaaacaattcatctaattgactatgaaaatatttctttccttcaatattgtcagacaccaaaaaacagttacttgttttaataccaattagcttcatcaaatttcccctttttaattttatttttatccttataaaatctctgttttatttagattcgaaaagctcagtatcttcgtaaatattaccgattacttcataactgatgacagtcgggtctgattcgctttttaaccaactcaaagcattcatctcacaatcaatccaaggccttaaatcaaatgctggatagttttcgctatccaagaatttaacttctccaacgtaataaggttcttcagcccatgtggtgtcgaaagtaatccgaattatatccccttcataaatctccttgccgttattgtccttcaatccggtgtattgtcgaaccgatttcaaacttttatcagcaaacgaaaattcatcaccgtctttatctgtaacgtaatctatttttccgttatcaaaagaaatgtcatgaacatcaataatttcttcgtaactgtctatacctgcccaatgcatattagaacccaaattgcttaatgtatgtttaactaccaacgcctgaaatttaatatctctcattctctccacctccttttattgtctccactcaaaaccgatattaacgtttgcttgtttaggtctgataacttcaactgtgctacctctgttagacagcctactttttaattccttcatatccttgtatggcgctatttgcaaggtgctcagatcgataagaataacttcatgtttatctttagcggcatactctctgtctagtgttctaacaatgtatacatcagcatcatctattttaatgaagtacccgtcctctaaatctttcacctttggcttatctgctttgttctttctaatctttaaattgatcgccattattctcacatccacttattttatttttatcaaataaatcaattatgtaggcttcgtacatctcatcccaataaggatctgttcttgctatgtatttctttactcttccattctccacaatcttaaaggtttgccccttttcaatatccgtgaacttcttctttgtccatatccctctgatcaacactacaacttcttttacctcaactgtttgccgctgcatcacattcctcctttttgattttcgtgtatcaagcctgtacaatattcaaaaaaccctaaaggatgatgaacatgtgtggcaggttcactttattttctgagtttgacgacatcatcgaacagttcaatatagatcaatttttgtctgaagacgcataccatccaagttataatgtagctccttcacagaacatcctgacaatcattaatgatggatcaaacaaccgtctgggtaagctaagatggggtcttatccctccttgggctaaagatgaaaagatcggctataaaatgatcaatgctcgagctgaaacattggccgagaaactttgcttcagaaaaccgcttgttagcaaacgttgcatcatccctgcggacagtttttatgaatggaagcgtcttgacccaaagactaaggttcctatgaggattaaacttaaatcatccaacctctttgcatttgccggcttatatgaaaagtggaatacgccagaaggcaatccgctatatacctgcacaatcattactacaaaacccaatgagttgatggaggacatccatgatcggatgccggtcattcttactgacaagaacgaaaaggaatggctaaaccccaaaaacaccgatcctgattatcttcaaagcttactgcttccgtatgatgctgatgacatggaagcttatcaagtttcatccttagttaactcgcctaaaaacaactcaccggaactgattgaatcccattaagtaccacagtcattttgctttatatatcaccttcgcttagctattatgttctaagtaggaggtgatattttgtttgtatcgccaatgttattgcattcaatcaaagaaccatttgatgacgatgattatattaccgagctgaagtttgatggaattagactgatcctctccaagtttaatgatcagataaagctttatactcgtcacaacaacgaagtaacaagcaagttcccagaactgttagatcttaatatacccaatggaactgttttagatggtgaaatcattgtagctgccccaggcggtgctccagatttcgaagctgttatggaacgctttatgtctaagaaatcagctcataaggtggtttactgtgtattcgatgtagtttatattgatggtcattcaatcgctactaagccactcactgaacgtaagagtatgctttcagacctaaaccttgaccatgataatgtatttgtaatcgaaggtctacaaggaaacggattagcttactttaatctggccaaagaaaagcatcttgaaggaatcgtactaaagaaagctaactccccttatgaaatcaataaacgttcccatagctggctgaaagtgattaattatgattacacagatgtgcttatcaccggctacaccaaagaggatataaaatttcttctgtcttatcctgatggtactgcagccggaataatggaattcatgccgaacgcagaacgaagtaaattccactctatgaaacatgtaaagtctgaaactgacgaatatatatttgtagaaccgatcttatgtaaggttaagcacagatttaagactaagcatggtaaactccgcataccttcctttgaatcctggagagtctaatctctccgttacataattccttagctcaaagttaattaattttgatgaaaatttagtacatgaatcaattagtttaacttgcccattcagcaaagctgtaggggtaatcaacactttcaatgaaaccgatctccttcgccttctgacggattttcatacaaccttcatagctgtaagcccatatttctttataatccctcagctcgccgtatttccctgttatgatgaattttctgaagctgttgactagttgccacatgttgcccccatgcgaaaaaccatttgcacgcccgtatcccaattcatatgggtaaacgtcagcgcccgtgtaatcatcaacgaagaacagttttttcttaaatctgaaatacgctatccgattctttgacttacagtagaaagtacatctatcaatacttgcgataagcttgatcaaatcgtttatgtcgttcattcgtttcaattgctctgctgttgccatctgcgcccttcccttctataaataactattttatttttattcataaataatcaccaaatgtcatagcctacaaaatcattcaaaatattcgtcattccctcatccccttcttctgtcaatccatattcatcaagcctgcttatataatcttctcgttcttgtttgatcattttttcacctcttttttatttttttcaattcttttttgattttcatattacttttcactcttttattaatagatgcgtgtcatacacatgccatctaagagagataggacatttttgtctcgggaggtgaaatgcaatgaaaattcttatggatctcttcacaacttggatttttgataaagtcatggattattcactaggtgctataatttggtttgtattcaagtccaagtcaaagcagaatgagtatcccgaagactttgaggaaaagcgtcgattcagactttaaattaactgactcgtattctgatcgctatcgccgagcgtaatgacttccgtaaataccacctgctcgaccggcttgataacggcttgcgcgatgcgatcgccttttcggatgatgtacgaacctttcgcaaaatgatcccaagctccgaggtaatcgagagcactgacgattttatctctgatatcgaaaagaaagtccttttcaatatctgtataacgatttatattgtcgacgattactccgacctctcctcgatagcccgaatcaactgttccgagttgcacacgcagtctagtattcagcgtaatgcctgatcgcggacggatttgcatttcgtatccctccggaatctcgaacgccaaacccgtcggcacaagctctgcccagcccggttcgataataacgtcctctgacgccactaaatcgaagccggcgtccgttgcgtgcgcataagccggaatctgtgcgtccggtgataaccgtttaatatttacgttcatttcgtttcctcctaataactgattaaaaattatcttttatctagacttgttcagctctctctatcatctctacaagctcttgtgccttgtttaattttctgctgtagtcttcaacttctttcttcgcgattgccattttatcaaataaaacgcgccagtttccattaggatttctgctgaatgatttaacaattaggccattaaaccagacgtctaaaattagtctgctctcacttgtttcaggtttatgaccaaaggcagcatctttattattaccggcataaacaatttgtttatttatttcatatagataattttcagtttcttttgtaactacatatgtattcattttcccaccccttatagattgtattgactgtctttaattgaattccaatcaaacgtttcaagtatgttaagcaactgctctacttttggtgccctccaagctgtcattgcataagtatgagcttctgaagtgtagtgatgcttgttcaaattgatgtggctcttcgcttcttctttggtcaaaaacattgtatccggccgtacaatatgaacctttctttctggaattaattctgcttcttcatcaatgtatttttgaatccactcaataggatcatcaaagtcgtcatttttcaactctgttaatgcttccttagatagctcactatcttcttttaaatcttccaaataatcatctaaaacatatgcttctgcaatatatggcaggtatacagaataccgttctgcattttcctctcgagcttcgacccattcataatcaccaactgtccagaaacgtggtgcagcttgtccgtcgttgtcttgatttttcaactcttgctgaagttcttttaaaaactgaatatcttgattcattcgtttcctcctattctgtttaaaatcacgattttatgtagactaaacctttttcttgctgtcatgcgttcacacttttgggtaagatactaatctgttaacagtaataactcatcaactttataattgtattcaccgtattcacccgagctccatttaacacctacagagccttgatttgtcacccacaatataattcccatttccccattttcatgccatcttacttgctgccctttctgataaccaagcatgtttccacccctttcttaaaaagcattttaatttaactttaatgtgtattgccttgagaaaatcccctttaattggtaaactcatacctaacttacatacgagtgggtgattccttgaataaaacaatcggtattgctggattaatcatcagcatagtagtgcaatcattttcggccgatgattcgctaacccaaaagattgctacgggtttgttatttgtatcaataattatctataattttgaacatactaaagattattctataaagtcacttgtaattttaggtgtttcctttattgtttttatgctagggatttataaaatcctctctattaccagcgattactttgaaaagcttaatgtgaattttggatacatcctcttatttgaaatagcattgattattgcattagtgtcgattgcagtaaacgtaatgaagtacattgcgaatcggttaaagaaatcacctgatggtaaagagctttgactctttgccgtttttaagctaaatacttcttcttatgtggtcttctatgtacaaaatcaaacgcaatatcgacttgtgccggttccttctcctctgctactcgctctgtaacaacgatcagttgtccattttcctggcggtcaatgctatggactgaatatcctttagcagcgtaatattcaccaataatctcatcaacgtggttgctaagcagattcctctttatcatctttataacctccacttattttatttttaccctttaaatatttatatgtattccatccgcagccatcaaatatgcttatatccgctccaagatgccacttaaaccaaactaagttaaaccaggctgtatcaattatgtatttgatgtatcctatgctaacgacatcctttcaactaatttttcaatgaattcttcttttctttatcaatatctttcttaagcatatcctcaatttcctccaatttatcaaccacttcaaatgtaaattcatcatcattggtatagcgaatctgatcacttgctttctttacaagctcaagcgcaacttgtctcggatctttatagttctcactcaaattcccacctcatttcattgaaataatccttttaaagtaattgcttagtagctaaaatctgatccgaataatgatttgcattcttcttgggtgaatggttcttcaagaaacaactcattttctttgttaaatgttatgcaaagttggttctcccttagaggaagtgggcaatcgccccgtccttcaactttaacaacgtcgcctactgcaatcgttcctcctgtaatcaattctttgaaatctaacgtgtcgtcattatgcgatccccaattaactccatctaaattcacaattttaaattcactcatgttatatccctcctcattcaggcgtatagcttatatccaattcaaaatcacatttcggatgcagcctccaaatttgatgtcctaagtatgttttcctagcgtaattcagacagttccttgtcccacttatacttccgtcataaacagctactattgcttcactgtgatcaatcatgtattcatttcgtttttgcattttagccggtgaaaactcacctggtacagctccactaactttatatttatctaattcttcaacattaataatctcatctgccacatcaagcatacgtttgtaccacattttttgttcttcagaccacactttatcttgttctttgaaaggtgttgcaattatgtttttaatatgtgggtatttcttctttagaatatgtacacaccagcaagcagcctgatcagttcctaacactccaccagttatgaaactggacttgttttccttagtgattaattcttcaattacttcaagcagcttatctttgagtttaagcattgttggatttttcatatcgtatccacccaatttgttcggcctatgaccagtgaagcacaccgttttctttcttaaagtctcctttttttgatatatccgctcacgttcatttctttcaatttccatctgcttaatatattcaggatcactaagttttttgaaagtgactatcggttctcaccctttctttaaaacagtctttttattgtgactgtataactacaattaaaaatctctttccttcttgtttacagttgaaccagccaagtcaagattaacattactttctttcatacatttgtataatttgatgtgcttcgtgctctgaaagcagaccgcccccattaaaacgcctaactatttttcgttttgctttactgagtggagacaagccatgttttttgaacaaatttgcgatatattgtttttgttttggtgtaatgaaatggggactatatactcggtcatcttgtcgtaaataagcttgtaggttagcttttaactgttcaccttgtcttactgccatatgaagatgcatattttctttatagacttctttcatatgatctacttgccttttcaaattttcattttcttcccttaattgtgattccctcatctttatttcccctcctttatatcatctgaagaacattttactttttattcagtttaataatgcttgacaaacccacttgtctaccccatcataaatttcgacttcgcagtgttgccctttttcatatttccaaattccttgatattcatcattaagtacgtcgaattctttagtttcttcatcaattaattgcgattctactagctcacacatatagctccaaactggacaacgaccgcttctaaagttttgtttctgtcataaacaactcggatatctttcactttataacagctccttttcattaaaaactcaattagatcctatttttaatcccaattaaaatgtttgggcctagcgacaaattcgtaattctcctcccaatcaaattgttttaacccatcttcttcaaattcccagcaatcaccgagtaaaggatcgtcaaattcaggaactctttttttaaatgttcgaagtttgttgaaatggctagctgttttaaatttaactttatccattggtgcaaatttcatcttcccatcaacctttctctttaaaattttacttttatcttgaattcatctggattccattaccacagtttctttttcaaaatcatttctcaacttgataatggaggttgactttagatatcctctgtcctttgtcttagcccatgcaaaaaatctattatgcaaaggagtgtaaaggcttcctgtattaaccgtatgctcatgtttgttgctgatcttatgctttaatcccctcatttgtttccaaaagttatagtaagggagcttaagttttgtcatgaagccggcatcatcttcaattacataaccctcttcctcaattgaaaagtcttgtgacacgtccagataccatctatagaaatctgtccagttactaaactctgcaacttgatttttgcactcaatggaaagactctctgcaactgccttcacttcactataagggagtttttcatacgtcatttgcctttttacgatgtctaataggactagtttgtctttactgtattcaatgatatgcggatctttttctggaagtgttacttcaaaaacgaatgaaacattatttagcttcagataatctttaatgatatttactttaaattcatcaaaggacttgaaaaacatatcttcaacccattttgcatgttcacttgttaattgagacgtaaaggatttagaagtgaataccaactgatctgacaaagagtcataccctacagttcctaaatatccattcgccttatcgaagactgttactggaaacttcattgtatccacgagatgatgcattcttgtttcagaccgttccccaatgttaaagaacttatcatagcttctgcttacaatttcattgctctcagtattaataaacaatccccttgccttaatatttgtttcatcccactttttctttctaaatgcttgctttgtaaaattaaatgaagagatattgtttggcatcttattctcttgcacatattcatgaccacgtaagtgtgaaatcaattcatcaattgttccaacagttgcactgttactctgtacttcacttgaaatttgtttaaagactttattcttcacttcatgcgtttcaattccgttctcagacagtgtaacgactctaagatgacctcctctttccacttgcccttctaagttatatgatctttctgctgctaacacaggcagacggtacatgtttctatgtccatgaatctgtacaacattttgacctgcagtattatttgcaaattcataatcaatatcgtctgaataatctccaactccattgatgaattgtgttgttgcggtcatcaagagattttcaggtacggttgaaactcctccatgagttacaatgtatgtagtgtttttatatgtaaagtaagctaactgatgaaacttcctggccaactgtctaatgtcttttttatcaatgttggattgttcgatttcaggtttagttttgttgttaaatgtggtgctaggtgtttcttcatcattcccatacatattgatatatctatcgtgatttccttccagaataatcacatttttataatctttaattttgatcatgaattctaacagctgtgcattttcaatacctctgtcgataagatctcctacaaagatgtatagttcattttcatttaaatcaccgtttaagtactcttgaagcacagtattgcagccatgaatatctccaaaaatatggatctttttataatcgtcaaaacatcttggcttataagtcatcgtgttttcgaactcatctggttttagaacagttacccaagatggcactttttctgttgtcattctttcataaatatttagaatactactctcaggaacatgtttatgttcagccctcattttatttctttttaagattctccgaacatcaacatcagaaaaatcaactacatgtacacggtatctatatttttgagctagtggcttatatcttgaaatcatactttgttttgaatgagttgcatcgacaattgtgaattcgccgcgatccatcctgtcttcaagcaatttcattaataaatcccacactttgttatcgtgtttcggagagatttcatattttccacttttgtttaacacaggtgactgaaacagtagcctaatgttgtccgcagaaagtgtgtattgctcaagtccattatctttgatccaagttgatttccccactcctgggcagcctcttaataacactaatgttctcaaattctatcaacctttctgatttttatttgtttaaaatgcatcttttaatcacttctttgcagcatagctctcaaagaattcttcaactgatcttagctaacggtttttatttggatcttctggatctctaaatcttttcgatagtaccaatgaccaattaaacatcaatggagaaaatctcgcccatttgctaaagcttaactgaagacctttccattctctccctgctaattccgctaactctagaatttgatcttcttttaaatttacttcttcttcaaacattacttgaatttcctcatatggtttatgtccaaaacaacagtggcgtgttttcaatccaatcatgaaattcaaaatatcaattaaattgatcatttgtgtatcaagttcatcatagggaatgccatttgtaatgaatttttctctttgtcctgctttcacactattccttaataacagggtagacctcttactcattccgcgccctcctcagtccaaaacaatctctcattcgttattttttccaccttataatttatgaggtagttattttttgcgtattcctctgcgtattccaatgcagttttatcatcattggcgccgaaactgagatgcttccatccgtacttaacttcgtaccacagcttatattcaacacgctttacttcagcattcactccgcgccctccaataactcaggattttgataaatgtctccgatgacttcgatttcacttagggatacgtccattctccaaaagtcttgatcgtctcccctattgaatacaaacgacccaagagaatctctaaacttgaccactgcttttataatcttgttttcgcaatagacagatttaaactttatgacgtccttctcgtaaatcattttttcgtttttatccttcaaccctgtgccccacatgagagccgcgtttctattcgtgctgtctacaacgggaaccaaaacatctgtgtataaacgtttcaaagtccaatcaccgttatttttgatggtaaggctcaacccttcatcatcccaataatgcatctgctcgccgtcccacaccctgtatgctgtgttcacaattcccgcgcctcctttgggttttcgtcacacatttcttttaacgcctccacaaactctttttcgctcatgttcagcggtgtgtaccactttataacttcgtgaaacggccggagataatttgcaagtgtatcttcagcatcttcccttccttttgttgtcccagtaaaattatttaaatagtcttcacgcgtcatatttatgtgcgttggacagtctaccactgaactaaatcggcagtaccgtccattcggttgcttagcgattaatgcacccatgttattcccccttatcttaatctctataaaacttaaattttatttttactcttaatacattcatgctgattcacaacatcacggagtatgtattgtatttcctctaaattgtctttaacaaaatctaggtctccaattgccattcttatttcgttattctctatgctgcgcaatgacctttcacatgacgctaagagctttgcatatttctttaaaaccatggttcttatttgattattagttggttcattaatcaataattaaagctatctcctttcctaattctaattcgattatataacctcaaccatatgttgtaaatacttattttatttttattctaaataattttaaaaaaatcagctttactcatactgtaaagctgctgtcttcataaacgtcttcatgccgtccagtttccaaagagtttcatttattttgtctctaaattctaaaactgaagcatgatccattctaatcctcaaacaatccccattgtttttaaagataatgtctatgtagtactctccactttgtatgttcttagaaccaacactcatggaaactgatctcataatgtctttcaagtcaatttcaagattaaaatccattgtatgctccagtctgactaaaaagtcaccaattttttatgtctcatgatgactgacaagatgtgtatgtgcttttattttattgataacagttgagaagatttatagccttcattttcaaacgaatcgtctatttcttcggcataagaggttgttatttcagcatcctctgtacacatgatgtctacatcaaatagtgcctcatatttttcttgatctttttgaagaaaccccattttccctgttttgtttcttaatttctttttaattgattgatatgcgaacaagagtgcttcctcttcattcttggcttttatcctgccaaaaaaaggaatgcacagctccccttgaataaaataatccttttctgacatacgtttccctctctctggtagtaattaaccgaacttatgttccctttttgttgacttaattataaccttttacctagttagtggcaaatcttttttctttcatttaaaaacttggaaagaattgatatagtatgataagcaatactataacaggaggttgtccgatgcttgaggttgaaatcggacaatgtttgatttccattctcctcgaaagtaaaggaatgtcattaggagaactttcaaagcgaacaggcattagtacgcaaagattaagtgactatgcaaacggctttagaccttctatgaatataaaaacagcgaaaatcattgctattgcccttaactgttcaattgaagatctctatgaatggaaaatcaaacattgactttatcgctagggagtttggcctagcgaacctccttgtaccctttttagggtatagaactattttactgcatatgtacaaatttgtctctgtctaactttgtcgaattctgaaaaatgtgaacaaaatcctgatatttttcgaaaaaatatcacgagtttatccgcacatgttttatttttactctaaaagttatgtaaagataatccctgcaacagggattaagaattagtctcaattacttcagacttgatacaatatttttctaagttatccatattcactactttcctcagtgattgtgaattaaactccgcgtcttcattcagaaacccgtattgtcgagttatttttttataatcaggtacttttaattcacccttctctttgtatatctcatacgccatgttgagctttcctgagttgataaggttcttaggtgaaaagaagggttcttctaaaaatttttgaaactggctaaaagatcggtgaactaaaaacttgtcagctttcatactctgattagaactcttgtattttagcctaaaaatgtttttgcttttaactaatgtagcaaatttgtttttaagaccactatctggcgaaccattgctaagatgataagttgtttgatcattagcacgcttaagcaactcataacatttatcgcttacagtaattattcttacaccgtgtttatcatctatcagctttaccttgttatcatcaagtaaatcgtcacctgttaaattcagtaactctgaatgctgatagccatctatgccttcataaatagcctgtatcatcgctttatcctgatcattaaccataaaatcaacatactcttctacttctttattggtgaatagtgtttttttgtttttatctataaactgctttaagtcaccatcctgtatctgatacactttgttgatgttactgtttgccaagccattttccattgcccaggttgtgtattgtccaattacagctcttgctcctcttagtgaatctatagatttgctatctaaatctaaaaataacgtacgcagctcttccaaagaaaaattaaatatgtctttttgaagtattttttctgtagctgagaaatcccttagccttagccaataatggtttcttgttgcttcactttcgtatttctctaaaaacttttccttcaattcagcattatatatttcactcatattaaattctcctttaggctttaaacaacagcaatttcatcataaaacattcgcttaagtttcttcttcataatattctttagttgattctcattattttgtcttcctaattcttcaaacactcttccgcttttactaaagtcaatcgtattaaggatattttcaagcttgtttagttctacattgttttccttcatcttcttggccaaataaacataaccgtaaaacattacgttatgattaatgtatgattgctttctaatggacgataaatcatcttcaagaaattcgtctgggaatgcataaaaaaggttatcaaaaaagtctaccaagtatttcgcaattttcaacgcatcttttcgagatttcaactcaaatacatcgtctatagcttcggataaagtataatatgttacaagaaaattgctatcaatagcaatttcactttgtgggcttattttatttttaagttcacttttaaatttcagctgctcgacaacggttgaagaataccgtttttgacccaattcttcaattctggatttttcaactgggttaattgtattcatttgagcaaagtgaaccttagccttttcttcatcgtaattgagcacatttaaaatgaatggttgatctaattcagggacttcagcaatggccttaacaatacctgaaattcgatgatatccatcaagagcatctaataaggttcctcgtgttacagtgagggtttggtcgcttgaatcatattcaacttcttcatcaccatcagatgttccaagacgagcgttaaaagttaacattgatacaattaaatcgcctttaataaacaattctttgatctcatcaactgatttagggtttgttttaggtacaggaataaggctgcccttaatgtactttccttctcgctgagtgttgtaattgtactgcaggatggagctattatataactcactcagttctttggcagtaatggaagtgacatagttatcctctttaattttaatcacatttttaaacttgtaggggagcttaactacttcttcaccggcgaatactctcccaccttcaagctcttttgccaatctggttggaaaataatttgacggatctaaagcttgcgtcccaagaattgaatacaactcttttgaaacaatgtacacttctttttcgtttaaacgctgtacgttgttatcattattatttaaaatttcttggatataaccagggagtgccttgtatttgtccgccattgtggcttttaattccttcaccatattgggatcatttttaatatcattaagatttttctctatttcagtttttaacttataaagtttatccgttgtcaacaaaacttcagacacattatcacctcacataatcatattaaatttatcattattttcataagcaagtaaagcttttatatgattatttgtatcacttgttcaaaaacattttaagtttattctgtatatacatgtctgattttaaaaagaattctttatattgctctaaggtaacatcatctaaaaaggacatgtcttctttttgatcaaccaaaacccctggatcttgagaataatccctttcattgactaaataatggtcatttaaagtattgatattgctgtggccagagaacgctgccacttttttaatatcaccattaatgctgtaagaaaagtttgttgcagtattgcgtaaactatgcggagttatctttctttctttgggaatgcccataactctacatacgcgattccacatatcctgtattgaatcaactgttaacttatgaaataaaagctcatgttccccatactcttgctttaacagcaataactcttcataaaaagcagtggaaatcccaactggtctagcctttttttgcttagtttttttaaagttgacgagatagcattggtgcttttctgaataagtaatatcatcccacccaactctaagtacctctgatttacgtccaccagtacgtgcactaaacaaaataaacatctttttcattaatctgttctgacgctcagtaacatacgctgcctcagcaaattcatcagcttcagatattccttcaaaagagcctgctgggttcttttctgttggaagaggtctaaaattaaatacagatgcatcacactcatgttcagattcaaggtacttaatcatacttttcagtgcggcaatcttattgttaattgttgaattggagttgcttttatttttagccaaatgggttcgataatcatacaggtcactcttcttaatcgccaggtcactctcagttaaatattcaatatccttggcagcatagtggttgaaaaactctcttatatgcctttcatacgtggctctagtattagacttttcaatttctccagtttctcgatccctgtttcttaaatctaattcatcaaaccacctatttatgttattgtatattgaataatcccttagtgttgacgctttcttttgagcttccataatgacacctcatatcatttttttcattaagtattgatcaaattctttccacgcaacaatccattcattctcaccttgaatattactcagcagcattatattggcgttacagatttccatttgctttaacatgtcgtattctttaagagcgttaattaagatgtctgcattcattttatcacacctaatttatttttatcctataataaaattcagtttaggacatttaccctctcgtccttacagacgtttataattggcatccccgtcaattcctcataaagctcctcttcgaacccaacccattcatcacttgtcgcttctcttcgtaggaactcattataagctactgctatctcaggctgctctagaaactttaaaacgatcatatgctttttccaaactttagccttgttttcttctgtataatatttattattcattttatttttactccttaaatacattttatagaatttttttgttctttaatgaggttgtattctttatgattttttctcattgtagttacattattaggtgtaaacacatctggatcctctaggtggagattgactcgtgtgaagttctttagttgttttatgtattgatattgtcttaatgatgtaatcttcaactcttccttttgagtggcactggttgtttccattgtttcatctcccaacaacgttcatcttgtaacttcattatatatgttgctagaataatatgcaacaatttattttatttttattcaagacaaataacacatcccctatgtatgtgttaaaatgtctgctgatttgtctttaatcttcattaggatacctttgctttatattttgatctaaccatttctgcttcattttcaagatgattatcttcctgggaaatttctaaattaatatctcccatttccatgtaccccttagccatatcctcataagaaagtacttgtccgaaatgctttttcattttaattcccccatgttcttgttttttatattatgaatttctggaacattctcttaaaattagaaaagacgcctgatccagtggatcaaacgtctagccaagttatgtattatctttgaagttaagccccgcggcttggtgatgcaacttttacaggctggtctacatggtctaccgatgctgtctcaattgattgctgtccggcaacaaatccaacagccattgctaacaagattactattccaagaataatatttttcatttaattcaccccccttcaattttagaccatgattaattcaagtagtttttcgtcacagcccattttccttagctccgctaatggaagattgataaataatttatcaccagattttttcaactttgcagtgctttcataaaaataattcttattttggtatagaatccccttaatgtaatctagaatcccagaatcatattcgtacaattccatattctcaagctcatttattactttctctgctttattaaattccttattattagtatagtaatatgctacctcaatcttatcagggatattatcagtgtcgaagtcaagccatttattatccttattccataggttgcttaaaaagcaaagagctaatcgcagcttatatttatgatgttcattatcacgagcaaattccaatcctttaagatactgctctttggctttagagtagctttcaaaaattaatgtgttcccatatgttagatgcccaaatacttttagtcgatttatatttgaattttgaataacttgttctgaataatacctagatttttcaatttcattatcatttaaataaatatttgcatttaataatgaaattctattcatatagcaatctttcacaaagccttcgggtaagtcgttgaaattgagaagtgataatgtgcttttcatcaatccaaattcgcctaccttcaaatactcatacatcagcatagcatttgagaaaaataacatttcatctgttttgcactttccggttgctcttattgcatcagttaaacttatcttactttcgctcaatcttctatgtatactgtatatattgccccattcttgacttgctaggttttttgagctagatagcctcgacactatcttgtctgttaacgtatcccattgattaatatctgagtattcaacagattgtctggcacattttttgttgggatccagtgataagaagtaatcacttagaagctgctcctcattatcaggaaacaagcttttaacaatattaattaaaccgcctaagttgtccatttctttctctggggtgttgatgaatttgtaaaaaccattaacctttttgtaccctgctatttttgagagtttcgctgcgagctggttgtctttttcacattcattcttaatcatctgcttaagattcattggttactacaccccttcccaactaatgttccctttgtttataatatacattagagttgtcagaattacaagtatttattttatttttattctaattattttttaaggaacccttatctgtttaaaattcgtattttatatgaaccggcacaataagaatccttactgtgccttaaagatatttagtcctagtttatcttttaatgcatcctgcagcacctgggaaaaattaatgttcttttcttcagccacttcatttaaccaagccggaatagttaatgttttcttaattgatttacgcctatactcatcacgaaatgcatgcataggcacatcaatcaaacacacaacttcgttttcccctgtcttaatttccgaaaacggtgagggactaggatacttctctccgtccatttccaacccgtataaatgaagacctaaagcttctttagccatgctaattgcttctgtatcattttctccacaagttatacaaccaggaaggtctgggaaggttactgtaataccatcattagcatagtgtaaaattgaggggtaagatacccaattcatttaaatcaactccttaaagaagattataaatacatttaaaaagtttgcaaattcaatacgtataattgaacgtagtatgtaaaccataaaaacaatataaagttttattcattaatttcaaaggagcaaaactttaatgcttctggtacataaagatcattaattggtctgtttattaaagaattatcgtttttcctccaaagaaatctaaactcttcttgttcagaatgcttactatctttaataaggcctggcaccaaataaaaatcagtgttttcctcattaaaagtaatgctccttgaatctctatatatgcaattattcgcagcatataaggcacaatttctttttttcattttattgtgtacccaatatgcgaaacttggaaaatcattaattaccattactgaacctccaaactttctcataatatttttatcataattgaaagttaaacaataaacataaaaatttttatttattattgaggtttgaaatgacacatcttcaagtctaactattgagtcaggaaaccattcttgtagttcattgtgaaggtgtggattatggtctcctgttttatattttttaatgtttaaatgtctgtttgctacaccttcttggtcatctccaacatccgcacctaagcttgactctggatagttattaaggtgatttacaaaaagtttcttgtccctcattaattttttcaaccatttcgcttccatgtatttataagctttctttggaaaatcttcaattggcatatatctcatcttacttctgctgtccaaaaaaatgccccctagtaacttttcaggttcttatgtctcatcagttgtatttttatttctgtcaacacttttaaagccgcttccattcaacatactcaaaccgctgctgataaaggtcttccaggattgtggcccattcaacccagccgtccacaacaatacttttcttctccccatcctcaatccattcaatccagtacacctgaacaccccatcacctagtaataacttcgatttgtctaatggcagaagtgacattaaactctgtacgcagctcgtttgctatcattaaagcttctgacattgtaatgaacttagaagcgccatgaagtcccttagatgtcttataaccacttccatctaatttaaatgacttgaagtaatcatcattttcaaattgaataacaaaaaaggtatcgataacaggcatagctaactcctcttcagcagaccagcaatttttatggccagtggcagcaatccaattaatatgtaaaacaccatgatatttattttattcttaaagaacagttcaatcatattctgctccatacctggtgaaaatgaatcaatcagttcctgcttaaactcttcatcataaacctgatcaacaaataaggccttaaatcctgtcagaaagcctacaccaagccagagcattaagaaatatgctattccaatcaaattaaaaccctccttatatacatcgtctggtattatagtagtgttaaatactttgtgtaggtgaaatttaatggaagagaaagattttgagactaatggctacgatgtaacagttgtatatgattataaggagtatcccgatgttaaatatggtcgctgtgacaactgtgattacgctttattcaagagttcagtgaaaagtggtgtgtttttacgtgagtgtcgtagatgtggtatgaagaagagcatttagtttaatgctcttttctatttcactggaatcatgtagcttacataaacttcaattccatcttcagttttatattctgcaatcctgtctggatcagtttcaatcttctctattagtcgtttcgcatccttgttcctctttgcaatattggtaactacaatccaagaccaataatcccattcagagatgcaagatttaatcttttttggtatcttatgacctcttgtataaaccttgatcatttacattctcctcacttaattataatttttacgtgctgttttacattaatgatggtattcttcggcacctgtagaagttaagataacagagtaagttgtttttccgatcattggatcattggttctttttattgcctccgaataaatctctaaaagtctttcatttgcatgataggcatgacggtttgacatttctgttgaaataaaattaacagtttcgcttataagcatgtcttcgtgatcaggggagttagaattaattttaatacttgaatcgatttctaatccaaggtaattatcatctgatgaaaaccccaacaattgtggtctttcgtctggtttaatatatccaacaaaaaatacggaaagtgggttaataccagaataatatgcttcaaaacatgattttccgtaattaaaagcttctctaaaaaataagagtggatcaatattactgttcaaaatatcgcttttttgatcaataaaatcaaaagctttttctgcaataaacattctacctgcaaaagaaattacgtacttcttattaataatttttattttcttatattcatctgattccacttttaaaattcggcccaagctatttgtagtagtcactcttttgtcagcagtcattactatgctattgtcgaatttaactgctattagcatcgtcatttgatatctaacccttcaaaaaagtattcctgactcaacctgacttacataactggttaaaagactggtttcatttcaacttaatcaatccttgaaaacagctcgttcattactctgttaggatcaataccattactatctagattcttacttagctgctccaataataggacaatctcttctcgattaaatttaaattcttccttgtctaagtctagtaacagttctaatgacttcataactttaacaatttggactggtgaaagatttagttcgacttcctgttccctgtcgattgcaactggaacagataataaagaagaagggacttttaagattctgcttccgaaaagaattctaaccatttgaccgttcaattcgtaatacttgtcttctagtcttccttgagaacctttttttcttatcaaggaagctttttctgacgacccattatagtaattatcatgcagcagaactgcagtaccggcagtcaagctttgtttttcttcttcagaaagttcgcttattttaacccattctttatctctagccaattaaaacccaccttaattatatttttcaatgattcttgaagcagcgtcattaaaagctgtttctggacactcagaattaaaaatatttaacaacttttcttcagtgaattcccttttcatatccgcgatcatttggttttcacagtcataagaattaaaacttaaatgggctaaatcactgagcgaagatgattctccttctgggattggccattcgatttgctggggatcatacatataaaaaccaccgatgtatttaaagctttgggatttatccatcctttgaattgtcgagtcgtctaaattcagctctgatatgaatctatacattatgtactctcctttattaattaagatgaaagaatgattttattcattaacaccattttcatattcaaggttgtatgttgctatttcgtgtactcctatatcccctgcaaagtttccatcctcatattcctgttgcaaataaaccgctttatctttttcgaagatttctcttgcttcaactaattcagttacagcttgtgaccctagtcgatctgttacagtaaaaactaagcaccgttttaactcggtaccgtctttaaggactacgtctgctatgacgtacccatttggctttagttcgccaatttcattgcgtcttttatcaattgcctcttgaagaaccacagaaacagtattgttatcggacttacttaaagccatttctaattcttcaatttcttcaagtaacacttgaatttcctctctcattttatctctccctttgttgtaaagtgcaaatttatgctactcctcaaagtgtctcgcaattattccactttcaacaagattacttttttatttccaaactctgtcaattcaatatttttttgaagaccctgatccaataagaagtgatacattttttctgtttgattatcctttttttcgtttggcattccccggaaagtcatattaccgcatgtataatagaggcagtaaccgtcgtcaaacatcttctcaaaagtgaaacccgctgaaatattgcttagtccttttactctgcttttagagctctcagattttttaaagctaccttttaataaaattcgctgaacttttgcttttaaagaagttggcaacatttcttttcctcttttccctatgaaagtacgattttatgtagacctataaaatttgtaagtatttactgttcttgtaactttagtataccatgatcactttaagtgatcaatatctttttaatcttttttgtaaatcaacagctcatgcagctcaatgtctaaatatgtacagactttatccaacagatcccttgggtaccgctccatttcatcatgatacagcttcctgactgtgttaaaaccatgatcaatatcattggacagctttcgaatactgatattcctttcgtctaatattggctttaaatttgatttaatcaatgttactacctcgcattcattatgtatgatcactttaaattatcattatatccataaaaaaggtcaaggatataccttgactatgtatcaagcttaccaatcaaatgaatcttcatgttcaaatccataaatacctttaatccacacatctccgcagcctggattctttgtaatctctaacacatgattacgattagcatctccctctactcgatctgtagcagtatagtcagcatagttccctacaaactgcttctcactacgtggaaatacccagccagcaagagttatcctactgattttcatatttagagtacacccttcagcattgttaattgtgaatttgtagaagagccaagtgcgatcaaaattccgatcaaaataatctgccattgaaaaactctctgaatcctcactcatgtgaaaatccacatttttgtagtctaatgtaagcttcgcctcagcacttggtgtgttaaaactcaatataaaaccaatgcaaatcacagccaaaaagattagctttttcattccctctcccccttttccaaattatactatattggaaataaaggtgaaagaacaggcagaggcttcttaatttatctgcattctccttgatatagctagatatacatgtatctatgaatatctacgtgtatttataagtatctatacctccctacatcacacaaatataccttattaagaacaaaaatatttattttagttcatttttaagaacaaatcttccatttttatgatataatcatcactgcttataggcagccttactgcttattcgccatatggtataggaaagaggttcttttaatgaacgtaaaacattctaactgtttctttgttatcaggctgtttgctgctctttgtgtgttgattggtcatgctacaagagatctaaatatttctgtctttggttataccccagagagcaaagcaatatttcacaccggcatatcaatcttcttttttctaagtgcattttttctttttacttcttatgagagatctcagcttaaaggtaataatgtaaccgatttttattggagccgaattattaggatcgcacccgctatatacacctatgctatcgtctccaccatcctgttaattgttctaggagctctttcattaacagtattcactactaaagagtactggacatggcttcttagcaattttgtgttataccctcaatacttccctgacatattccatcacatcggcacaggtcgccttaacgattcactttggacaattcctgttcagattagcttttacctggtgttacccgcaatttattggttttataaacgtttcggattcccaaaaatgattctttgctcttttgctgtttccgctttcagtgtgttagtctctttcataattttaaagttcgcgcctggcagtgtgttcggtaacctgtacttacattctttcctgccgcagatgttttatttcactttgggcatcttctgggctaaggcatggagcaagttaccgcagcatatcgttttatttttgtcttcggtaattttatttttattctataaacttgaccttctgcatctcagttcaataaacagcaccttatggagctttttatggttcgtacctctgagctatgcactcgtctggtttggttacaatgggccgaagatattgcgacagctgaaccggttagacgatataagtatggggattttcatatggcacatggtgatcatcaacatcttcttatacactggaattaataaaacattgtctgattacccgctgatcatagccctaattgctgttactgctgcatccgcatttctttcgtacagaatagtggaaaaacccgctcttaaattacgtaatatcaagaaaaacaaaccagtcaaaacaaggattgcgagctaactgcaagggctgttcttatgtaggcagcccgattcccgttttaaaataaagtagtgtttttgttcaccaattccattctccattaggctctcctgttggcttatacataagctcaatatcaacaaatgttttatgattacccttaggaaatctaaccaggacaatctcacccttttcaggaacaaactttacatcgttcctccaaaatttgattgttttatctccttccttagtaattggtgttgtatgataaccatatttttcggcttgagtgctagagatcacgttgcctccataaacatattcacgttgtccattacgtgattgaatttccctagtttttaaatcatatgcgtaaatgtcatattccttattctcttctttgtttaaatatttgtcattaagtgcttcactttcttggcttgaatcattgtcataataactttttctttcattttcatcatcgtgatttacctctaattgagtatccacataaacttttgtattgttgttaaatttactacactgaactataagaaataccccgataatacccaaacataaaattattaactttttcatcacttctcctttagtttcttcgtcatccctcatgctgttgtacatattttaaagtaacttaaatgatttttttatcgatgcaatacatatcgaatccttgttttataattcttgcctttccattagctgtagaccaactttcacttaaattttcaataaaagaaaaaagtttgtgctctaattttccgggcgtaaccttcataacattgcgaaagattttcctatagcgaaaactttcttcaaactcaatcataaattcatttaattccttattccatgtatccaacttttgatcattgagactgtaggaagatcggttaaatgagtaaggcggatctatagaatagagtgctactggcatacctttgtaaaggatttctgaatagtattggctttttttaactccccagctaaggtcattctccttaaaatacctattaatctgtgattctaattctttaaatcttaagtatgatttatataaggaaggattctttcttgctctagttacctgagcataaattgttggagcttctgttatcttggcccaaattgtacggtgtgttccatcaccgtaaacagcataaaagtcatcatcttcataatgaaccaatttcactggtgagtgttgataataagtgtgaaattcttctagactttgtttttttaagtattcaaaagctttttcacatcggccaatgtcaatattatctgtaccgttataacacgcgtgatcaaaccaagacacaccactggttcccctgaatcctaaactcttaattttttttaacgggacatcccgatatagtttttcgctgtttccgacttcatcataatacaattcatatggatactcacttatatttttggtgtccttcatttccttaatatgaaattcacatacacccttttcaagaagcaatttttcaagtttatttttcaaatttctccccccaatgacgtctcaatatcattgacaactcatgccaataggtggattttacattttttctttgcgatgataaagaagcgtttcgaattaaatggtgtttttatttagacaggcattcctcttaataaaatatttatcttattatcttctattttcaactaaggttgcgatacttactttataatctactgacgaagcattcttgtggtttgcaacgtcgtcaatgtcagcaaacatacctccgcaactcaagtcattaatcaactcgatattaaccaacggatcacggaatgccttgattctatttttatacttataaacttcgttaacaccattttctgcccacatcactaagagcaataattctaattcacgcatataattcccctttcctattaaactgctgttttattcagatttattatagagtttataatcaccttcgccatcctcatgatgtacgtctttcgattcgcattttttacaaatataactacctttattgaagatattgtctatacctgaatctgaatagtctacatcataaatctttccgttcctagctccacctgttgtatcaataagctgtttggctcccaccgatacctctaggtagaaaaaacgttcattaccacaatcattacatttagccattactccgcatcctcctctgcatataaatcataataattttgtttaattaagtatctacttttccccataagatgactttcgctacaaacagtttcttttgttttcttgtcaagaacagccgtaaaccctgccctctgttttgtttttaggactctgctattggtatactttaaataccattttctaaataaatcatattcttctattgacacttctttcattactgccattacttcatcatctcctgtataaaattgttgttttatccacttctttgataatgtttgtttatatctttaagtacaatagctttaattttattttcatgctctttgtctacaaaaatccttatcacattatcacagtctatgtgttctaaatgctcaagctcttgctgtgtatcaatataaataatatcccctatacgtttattcccgtatttatcaaagaaatatttaactccctcgtcatattccctgtcccatctttccatcctaatttgatcaattggtgaattagaggtttcattcgtaaagtcagattgatcttcctcatttattttagttgcactcactttcatttgaactcgttcgttaatttcttgagaagtatcttctataataagatattgattaataataaaatctagtgcgttaattattttatttagataaactttttttacaggcttcttaaattgattgtaagtcaaaggtacttcaatgtaaccacgggcaagtgtatcgtactccgcaaaactatttgaattatcatcacgctgaattaccttatattcaatgcaaaggctattagtattacggtaaaggctggtttgaagcgttgtattgttatctaaattatataggtcgcatgttgtttccatacttcctctgaattgattgaaatctacttgatatgtactcatcttaatgtctccattctgtttaaaatatgcattttattttatttttacccttaaaatatgtatgctttcgctgttgttttaacttgatttaagtatatcatgactattttaaataatcaatacttattttatttttattcttaaagtgtgtattttgttatgatgtaagcaagagaagcttcgatgtatccagtatataataagaagcgttatttaccgtatcactgtaagattgtgccccctcaaaatcatttattacgtctttttcttctgccgtcatatcctgatattttaccttgccatacgaaggaggaagccagtttttcttttggctgccaaaaatattgaacttcttaagcatttccttgtctttaaactcaatgtgacatgtcccttttttatagaaagttacatagaagtactttaattctatttttttcgtttcaccgtaatgcttagccagttttagagattcatctatgtttatgtcttctgttaacccgttgtcaaggtaattgaaaactttttcgatatctttcaacttttctaagaccttgtagtctgttggactatagtgaccgagccaactacaatacccgtttagtggaataattatttttttattaattttatatgatttatttgttttccacccattatataagtgcacattttttgatgattcatcatagtaatgcttgtggctaaattcttcaaaaaggttaagtattgtatcttccacgccctgcgtcatctctttgctcatctgaattctcaatgtatagatattgaacaaagaaaagtcataatcttttaattcctcaacgtgctccaaatacttttgtttcagattgcttgtgaagagccccataaattgatcattgttaaataacgtattccaatacttcgccctaatttgttttatatatgcattctctatgtcattttcttcggtattcttatcaattagcagcttcaatattggagtactgtcatcattgaaactatgcagcattaagggtttcaaactgttgtattcattgattaattttaaacccgctttgatttcatagttgaattgttctacaattccttttataaagtccaccaactgtgttgctttataatcctcattaattctatgtgactcatcttttttcaattcttctattagaacgctgctatattcttgtttttcaatgcttatgtaaattattgctgtttcaacttctgtgtttcgctctgagttcgaaaaagcgttttgaatgtattcaacttctgcatttatttcctctagcttacgtataagaaatttcctgtcatttgaatacggattttttaatgtttcggcatttagtaagcaaacaatttggccggatctttgttgcttttcaattaattcaatcgcctttaataaatgtttaacaccgctgctaaaaggtggattcataaaaatcaaatcatacttcttgtaagtgttaaacgtcagaaaatcgtctgctatcactctataacttttcccctcaaggatgtgccttaagttttcatcttgttcaattgaatcaatatcatatttcgaattccctctatagttcttggtgtatttgaattgattgtgaatagcttctaccaaatcccctttacctgctgacggctctaaaacagacttaatatgcttccattctatttttgatgtcatttttcggattaactgtggtggtgtcggataaaaatccggattatctttaaacattttttgttctccctttttagggaatgagatgttttctcatcccctcttattttatagactaggtttatatgtgttgattagaggtttgaagcttttattatttaagtaatttagaacctcgtcaaattgtcttttgtcacacgagtagtacttactgtgaattattttagtcccatctggtttaacctctacattattcaacacagtttcgggcagcgagtgccaccctttgaacatcaataattctgaatagaagtgtcggtaatataaatttcttttattttcaggcttgtatgtcaacttcactgcattatcatattgagcatatttagttgactggcaactgtcatacgttattttttcagtaattaaagatccaagatcagatatgtaaaacagagtatatttttcacctttttcaagatcagcatttttaaattgttcttgaatgctgtcaacttcatggagaattctgtataaagaaattttcaattcctctgtatctgcttgttggataatttttttactcaaatttaaattattcaatttcaatttttctttgagtaaagctttatatttgtcccagtcttcattattccaggttgcaaatatatttaattcttcaatgactgagctagaaagatcttctatttttcccgcttgatattttaactcgtctaattctccttcttttatcgcttgtttatcaaaaattgacttttcaatttttgcattgtccactaaaccaacgtatcttgcataagaatggccttgagcgtctacaataaattgcaatttcccgccgtagtacactcctacgccatataaattccatttaactgtgttcttttctaaatcgtccatattgtaataatcaatcattgagttgatcctgttgtcttccgtaaaacttccaccggtttccgcaagaaaatcaaaatcatttaaaagcaagttagaaaagttgtttaaagcttcttcagtattgaaatgcacttcttttgtaattttcacattttcaagtctgtagtcacctttagcaacctcgtctttatattgatcaagtgcttgatttttgtttaagttggcaaactgtgcatcaataacaaaatactcttgatcttcattcagttgttttactacaatgctgctatagatattttcggcttgtttcttttcttcttgccgtctcttatattcagcatttttgatttcttgttcttttaaatattcctgaaattctttttcttttctcgctttctcggcttcttcgaattcttccatctttgaatcaaacagtgtcatatcttctttaatttcttctgtttgctctgtcactgtgtattcccaatctaatgaaacacgaccatagaaattgtagcttccagcatagtcagtgtaaggatctgctgggctgtagcaatggcgataattgtttaaaagactgttgcaataatcataaatcgcagtcaaataagctgagcctttttcataaggacttgatttgattgtgatgttaatagtgctatgtgaatagctacccccagtagtaacagagaatttgcattgtgggagacgttgtcttaaatgctttcttatttcctttgccatttcttttacttcttgttccttatttacttctaattcactccattgtgttgcatcccacagactcatatttacaccattagctttctttttggtttttgtgattgttttagaagatgagacttcttgtttagtaacaccattagcgacctgcattgatttttctgtccgtttgctccaccaacattttttgaatccagagtatcgaaaaccgtttgatttaagatgagttaaaacctcttgttctggtttactatcaaaatatagttcaattccatttaactcttcattaattcttaaaacagctgtcattttcaacctctccattctttataactattttatttttatcttaaatgtatgtaatcctttgacttgatttaattttaacatgatcacttaaaataatcaatagatattttatttttattctaaataaagaaaatcctattatcgaggttcagcttgctgaaacgagacggccgtaaaggcactttacggacgaatttattattttttatttaattatttttctggttctccttaagacttaggctctaaaaccgttgatatgactggcttattttttaagtttaagaggtttgtcctctttatcaggtatcgagccagtttgtgagcagcttcctcattcttagagaaggtatgtacaaagttatttcttctccatccctaatagctgacctccatacccattgcactaactcagacaatgcaaatgcgtcctggtctattgtaatactgtacttttctttaaaataattatacagaacagtattcgtatatctgtttattgtatatgctaagtgtttcttatgcttaaactcgtttgtagcacgtgcattacatgagacaaacccctttgtatacccattgccctttattctgttcttatggtctgaataagtcgtccacatagcttcatcacttgacgacttaacaatattattaaagtaattgaatacattgttcttcacctttttgatggtgtaaggtgatttatttttataccaattagaagacagtgaaaactccagttgtcctattgtgtttagatttccttcatatatttttattttgtttcttaactcttttttaaagctcctttcataatcaggacggtgatcaatgaagctatactgtccatccatgtaagctgaactgtacttttgatacttaatgttgttcagatcgtagtaatatttttgtatttgagcatcaaacatatatgtaagtatgtaaacttccttgaataactggaatacatcggctggaaagttccaaatcaatatattgtctttgaaatacattagattgttatttaacgccatatctcgaatgtcatcgtatcgtgtttcatagtcttttttttcttcattccatttgacaaaaccgttttcaatataaatcagattggaatcaaacagtgttgttagatcatgtttctttacctgtaattgttccactacttccatgacttcatctaatatcagtgtgtaattgcctgcaagtataagttcctttgtctcgtcgtttgcgtttttaaaaaggttatgagttgccacaatgtttttattttgtgataagagttcgtgaaaggattcaaacttatattgtgttttatcacctttcttctttactttaggttcgaaaaattgtttggactttatgcttttctttatgcgctcaacttcatttaaataaggtgtgatgaatataaaggtttcttctttaccagcagaattcattttgttaatcgctgcagatgttttaccgctccccataaccgaatcaattattttaattttattcataataagtgtagacttccccctttaatattaaaaataaaggaacggataaatgttttaccgctccttctcatgtatgaaattcaattgttgattctttcttcaagatcatgaatacgtctttcaagaccagagaatttcttatcattgtatcggtggtcactttctacattcgcggaaagatactgtataccctcaaggattcgtttcctatcccgctcacctctaataagcatcggctagagttttaaaatggatatttaaaagagtagtgagttaaggtgttcagctacttctgcctcttcccccttaaatacaattttttctctatcaatgatttctaattctgacatgttcacacgtctaactttatatccctcaattgtctcttcctcttctatttcaaaaattctatcttctgtaatcatattcttatcctcctatatacattgtatttttcctcttaacttgtaactttattatatcatgatcactttaaatgatcaatatctttttgatctttttttgtaaatcaatatccagaaaaccacaaactttatttatttaacctcttacgtaaagtaaaataaatgatccatgacaaaatgacaatgatacacgttactatgaagatagccgtaatcagcgactgtattccgctgctgaaataatctttgatgaacagaaacaacaagaataaaacaacaaatgttatgttcgtaaaccataatgagaatcgtttcatgtttacaatgtgcttgtccatgttataatatgggtagtgactaaaggggattaattcccctttagcgtgttatctgcgtatacgtttgcgttgtctcttgctacggaggcgcttgcgtgtacgctttttgcttttcttattcttcatcaggttttgaatcttctcagctatcgttaaacagttgatgattaaaaccgtgataggaataaggaaagcaattgttatacccactttctcaagcactatgtacacctcctttcctataactctattatagcacatttccctttcaaagtcattttatttttactcttaaaatggatttttttaaattattttggcactattattcatggctatttataggctgtataaggcgtgtatgtggattggataccaatgatactatgattaaattaaaattgattctaggtggattagaatgcttctgatgatgtgtgcttagtgtgtataggatggatatatgatgtatggtgaaggaaacggatagagatgattaggtaagctgaggatagtttatggtggatgcaatgtaatgaggatgggaaaagatgaacattaaggatgaatataaaataggtgtgtagttagatgaggaattgtatagataacacttcgatttgtttcctttcgttatatacacgattattttaatgaatgggtattcacttttaagttgaccgcttaattattttttcaaaaatatatattgtttttcatttgaaattgtgttagctgtgcaaatttatcacctaaatcataaaaaccctacataacgtatcttatatagggaattaaataccaatatatagggggtatattaacatctaaaggccaaaaaataggaacaaatgtacccctagcacttccatttccacaccaaacttattttttcactttcccatttttcagcctattttcacatcgtaatcgctatcgtaaaagcctataatatcaatgtttttccaccccttattctcccctttttcatcagatttttaaataaacaaccacttttcctctctcctgtctacgttttacgatcacaaaacacctattatcccctttgacagccctaaaacattgctatatcaactaaataaccctttctgatcttcatttacgataagcacttttatagctaacgatcacccgggggtcattaaaaatcaaaataaaaaagccaccataataggcagcttccctttaaaattaacgttttagtctcttcagtgcctccatatacgaggtctttttcgattccttgttctccagcttcctcggcttgaataaatcctctctacggcgattcttcgctttatagacagttgtttctttaacttcagtgtttccactttcaattagatcatctaactgcttcatccgctcattgatccaggttaatccactaaggatggttattgccctattccctttatcataatgtcctttaaataagtctaggggcatcttgttatcaaagacattaaacagctcattatacgatatatgctccgttaaaaactcatgaacatccagaatgacaccagctctcatcacatttgtaaactcaacaggagtaaatatcgaattgttccacgacttctgtatatcttcatgcagcttatcaaaatacttaccctcaattgtaaattcattgaggtctgtttgagcaatagtcatgattcctggtgtgtcaaaaagctgatttaaatccttcctgtctaatgtactgatctttgatcctctgtccgtgtaattgagtaagacttcgattaaatcaaggaacatcttgtttgtctccttgtatagtctgctttcagaaatcttcccttcatatttgctcaaaaccatttgattatccaaaggtaagacacaggtctctggcatagataagtcatcaagtaactccagtgtattcatctggttaaccaatacctcattattgtcaggaaggattggtacagcaactattgttttatgtgtaagacattcgtttaacaattctaataatataggggctactcctgaaccggttccaccagctgcagagaaaactacgaaaataacttgtactgaaggcttttccattgtgttctttatgaactcaatagaggactcccagttatttttcatatgtttcgctgctacgcttctgtctttacctactccttctgtccctaccagatgaagcttatcttgaatattgattaatgaattaaggtctgaaagtgaataatttattgcaacagaatgaaatcctctcttcattgcttcatccgctatacttccaccggcctgaccaactccaataaatccaaacattaaaccctctccctttttaattgatatctcaaagcttcttgaccatattgagtaataaaaattgtatgctctttactgtttttcactataataataaactgcaaggcctcaagacgatcaatgctctttctaaaagtagcatcagttagttgagttttagcttgaatggttttcttcctaattgatttaaactttaaatcagccccttcatcgctcaataagcctagaatatacagatcatttcgagttaagttgtcaatgacagaagcaaaataagtatccatgtgacccctccttaatatctgatgattctgaagtatcttggttgatatacgattattatattgtctatttgcatttaaatgcaaatatttttgtatcttaatgcaaataatcatactctgcttgtatgtaaaccagtcattttataaaatttattcaaacagcaaaaggatgatttaaatggaatatagggttaaaagtaagttggattcatttctaaacagcaaaggtattgaaaaaggctggttagcagagcaaataaaagctgaaagagcaagtatatctagatggtgtaaaaatgacagcgagggatttgcaaccgtcctccctagtacatacaatcttttattgatggcacatattctaaattgtaaagttgacgatctttttgaattaatcgaaattaaatccaattaactttggatttttatgtttacaagagtaaaaataaaatatataataaagacacaaccacatgaagtggtctttattttaatcattttaagagtaaaaataaaatagtatggaggtgtaagatgaaaaagcagtatttatttagtcatttaatggggtttattgagggaaaagtagtcgatggtacagcaacacccgaagaagaatacctttatcaggattacaaatggtacggaaagattaataagcaaagctttacatatcgaagtttagtaaatcaatatcttaatagcgaatattaagcacatttaaagtaaaaataaaatagtaaggagaggattgattgaaaagaaaaaaagacggattgtctaagcaagttcacatatacagcgtggacacatcagcattttataatgacaaagaaaattcattacataataagattttgaagtcttatagatacagagattatcttaagacattagacaatgtaaataataaacataagaaatacatttcacaaagaattacataccttaaagaatgcctctattctgcattcgaagaacataatgacataagaacacttcgaactgacagcttaagggacaataaagtgatttctttatttgattcagtgttgacccgaacattagggattaaagaaaacaccctttcagaggaaatcatggttgtccagacttaccattttgaagtattgaaggacattattgatcagggatttttacataacaatgaaaaatacgtttatttcacgagcagtgccggtcaaattcgtacaaagaagtcatgtttcattaaaaaaagcacctacgataagtatcaggatgctttgacatgcggcttgagtattgaaaagattaactcccttggtggtagcagcattaacaaatggaatagctatatggccttatctaacagtgccagtagcccttgggagattgatattgataaagccattgttgtcgacgacttagaaactgatgtgtcgagtctcgttgactatattgatcgagatacctacgagatcacacgaaaaacaatgaacattcccattgagcatacggatggctgcggaatgattctccccactctgagtagcaaaagcttcatggtcagactcccatgggtaaagggtttattagtcccgtttgattttcgcaaatttgctgaggaaaacaaagcttttaaagtaactgatatatacggcaaggaatgggacgtagtgaaagatgatgttcaaattatcttcactaaaagccagtttaaaatgtggaagtattattcatcgtgggaagaatatcaaggcaattataaaaaatatggatgcttaggggcaaaactcaacgaagaagatccttctgttgaagggaagctcacttatcaaatgctccaaacacttacagatatctccggtgaagaattaattcaaatgagctcaaagactgtaaaagagattaccacattgggaactgacaaagaaaccatgttaagagttcttggagctacggagaaaaagaaacatcggacagctcttcaggacgctttacttctatatccagaacttcttaacgatgatcacacgaaagaaattattaaaaataaaaagaaaagcatgattaaagatgccaaatcaggaaaattgcttgttgatggtgctcgttatacatacttatgccctgatctatatgctttctgcgaaaaattatttctgaatatccagaatccaaaaggactgctttcaggaaatgatgtccattgttctttatatgatgaagggtatattgacatcctccgctcccctcacctattcagagagcatggtgttaggtggaacaaaaaagatgagaaatatgaaaagtggttcattaccccaggtgtttacacaagcattcatgatccgatatctaagttgctgcagtttgataatgacggggataaggccttaattatttctgatgagttaatcgtcaatattgccaagcgtaatatggaaaacatcgttccgttgtattatgaaatgtctgtagcccagaaacaaaagattaatagcaggaacatctatgaagcactaactcttgcttatgggatcaatatcggggagtacagcaacaacatcactaagatatggaacagcgacaatataaatctggatgtgatcaaatggttatgcatggaaaataactttactattgattttgcaaaaaccttattcatgccgacccgtcctgatcatgttgatgaaaaaattaaagattacataaaaaataaagtgcctcacttctttatcaatgcaaaggataaagaagaacatagtgttgagttaattaatgaaagcacagtaaataagttagactccattatcccttctgaccgaattaatttcgcagcagtggcaggaaaatttgattaccgcttcctgctcaagaacagggatattaaattggacgatgcaattattcgtgaatataaacgattagaccagaacaagaaatggctcatgaatgatgaagacattaagcctgggcaaaaactttatgtttataaggtcattaaagacagattgctgaaaatctataatgacgagcaatctgttgctgatgttttggttaagcatttatataaaaagaaaagcaaatttaaatcaacattatgggagtgctttggcgatctaatattggaaaacatgcagaataatttaaaaagatttaaatcttgttatagttgtggaaagatgtttaagtcaatctcaaataaatcaaaatattgtaataaatgtgcattggaaattgaaaaaaagaaccatcgattaaggcaaaaaaaatacagtaagaaaaaaatgacgaaatagaaagtgtattgagccttactcccccaaggggtacagcgattttaccggaaaaagtttaacgaaaaaatccccttgaacccttgatataactggtctgaaagccctttttgagataatcgccataagggagaaagaaagctaatttccacatataagggtgagtacgtctcccattttttcaaaagaagcacaaacgataccgtaattatactttaacacaaaaataaacaaaatcactaggaggaattaaaacatgaacaaaacagaatttgttggagaagttgcagaaaaattaggagttactaagaaagaagctgcacctaaagtggaagcagtatttaatgtcatcattgaagcactaacaaaaggtgaatcaatcaagattccaggagttggaacgtttgaagttcgtgaacgtgcagctcgtaaagggagaaatccgcaatcgggtgaggaaattgatattccagctacaaaggcacctgccttcaaggctgctaaagctctaaaagacgcagtgaaagcttaataaaatttactgaggacgacaggaaaggcttcctgcacgcctttgtcacatagagcttatgctcctaaaagtggcagagttagaagttatggaggaaattgtcgacctcccctcttttttcatgtattcatctccaggtttattaattagagttcttttattgatggcatgggggtgtcgtcaataataagctgtttactgatatgtgggatatcagttctccgctaatattcatttgtttgaggtcttggatgccagggttttggataagtggatattagcggggtattgccccatcgtggattaagctttttctaaacattgctattctcactttcatacgaacaaaagcattaaattcgactttacagctacaactggtcattgtagttagtcggataatggtcacttatgagggttcgaggttaactcgcatgtctgtatctaaaaagagacaggtaaatggctattatcgggctaaaaatgtcggtaagacttaacgcattattgcaaattgcgactgaatcccatcagggtcttattatgggtggcatatagcctgaatattaattgcggtgtattgcttcggcttgcacttaggtaaggtagatgcgtctcccttccctttaaataatgcccttgtaagctttgatgcttattatgcggtcacataaaaatttttccgggttagcgaggctttttgtaattacatcccctcgcaaaataagtgagatggtttttgggcgattgatcaccgctcccatttcacagaaaaggattattttcggtcttgccttttcaatttcacttagcaacacgttcactttatttcacttcatctccttcaatgttctgtatggagacttacctttcccatgcacatacctccttacacgggtcagagaaaactgtgcaaaataaatggcgagcgtttgagacgctttgtttctcaataaggcgtgtaacccgacaagagcatttaaaatgccattgagaaggcttattagggtcttccttctcaaattatttttcccttggctctcagactctactgagcagttggcaagcaacataaaaacttgatatataagatgtaaaggtaataggaattttaacacgtcccttaaagcgtgtatttttgttatcatagctcatctgccaggtgtagaaggagccagctggatttcgcacagcgataaccagccttttatgctcatgtaccatgatgtacaaggagtttctgaagacgttatttggcgtcttttgttattttcgacttacaaagatttcgaacgatgaacccgtaatcagcgtattccctgtcgattttgcgtacctacgtgagttaatgaatattatgtaaaaaaacgctaatttcgtatatttttcaagggaggacgaaaatgccgatacgtattaaattcgacaaagacgcttacttaaaacgtcatagagaattccgggaaaaattagacgagtttaagagcggcgattatgaggaagcgtataatcaagcgcaggtaatcttagaatcgagtgtcttaaaacctaacgatgcggtggcggaataggtagacgcttagacgaacataaggacgatgctgtgaggtagacaacgggctacttaatagtcggtttggctaacggttgttgaaattcgtccatgcgaggtgcaaatcctcgtccgcataataaacgaatagccaaggcggcgtgtcaagctatcgcagcttgctaaaagccaacagcgccaactatacatccggcattgtccggcagagaagcgagcgagtaagggatgcgtcctgatctcggtgtatagacgcaatcagaacgaggcttccgcaccctacggcggaggtctttttgtgcttgcgttttactttactgatcagccggaatgtccttacgagacttctggtacgcaagttttcaataatctccttcgggcgtttccccaacgcctatccgactcatattttcatctccttatatccccttttcggacgttaccgatgtttcggatcatcgggcttccgaaggagcttattgtacgtaaataaaacaaatattggaggaatttaatttggctaagaaagttcatacagtaaatttaaaaggtaactatacttacattgatgggattattgaagaagaaacaaaaacagacatcgagcgttatgatctgaattctattttaaaatcatttgacggtcggaaagtgaaaatttctattaccgaagaagacgaacttccacaaatcaatgagtaggtggtgactgaatgacagctattttagatactgttttacaacgagaaaaagacgaatcatttactgattatcatatcagacttttcaaaaacaaagacacttatcacattgacacaaaaacaattgctgcccttttaaacaaggatcagggaaccaactatgatgaaagcaaatggcgtaaagactttaaacaatttgagcgctggcacgattactttatctcaaagaatatgaacaaagaagttcaacaaaaacatgaagaaattcgcattgaatccgaaaaacaaacaatcaaagcacgagatcaaaaaagagaatatcggaaattcattgccaatcaagcacggtttgaacaaattaaagatgatgtcgtacaagctattgcatctttagagtcaaaaagaccccttcgcttcaccttcccatcacctgctattgctgaaaaacatggactcgctctattcagtgattggcacttcggaatggaaatcgacaaccgcataaataaattcaataaagaaatctttaatgaacgtgtagaacatctcaccaacaaagtgattgagtatggtaagcagaatcatgtttccacactgcatgtagcaaatctcggtgatttaatcggaggtcttattcatgtgtctacaagagttcaggccaatgaagatgctgtagaacaaattaaatatgtatcagaaacgcttgccgaggttttagcgatgttggcaagtgagtttcaagaggttaagttctacaacgtggcaggtaatcacggtcgcctctccccttctaaaaatgatgtagggattaaagaaaactttgaatacctcattaattggtatcttgaagccagattaaagaacatagagaacatctccattgaacctgagcaagacggattcatccccgctaaaatcaacaatcaggaagtcgtgtttgtgcacggacactacgatcgtgttgatcagtgtgtaacacgattacctcaattacttggctacatcccttcttacatattcggtggtcatattcatcacaattatgaaaaagagtacggcagcacaaccgttgtagtaaacggagcgcttgttggtgcggatgattatgctatgcaaggtcggtttggcacaaaaccttctcaaaaatttatggtttttgatgatgcaggtattgaggctacatacataattcgctttaaaaatgaaaagtaaaaggaatgatcctatgtctgcaaacgattttatagaaatattagcagtgcagtgggacaacctgtcccctgaaagtaagagcactctagtaaatttgattgttaattaatataaaactttaattttataaagatgaggatgaggaagattgaaagaagaaactaaaattctttgggaatatgtaaagctgctaaaagaaattaatgatagtggttatctgtgtaacagggaattaaaagacgccctgacaagtctgcataaaagcctgggatttgagaaaaacactaaaagtgaacaattgaaccgagacgtcaaattctctactaaacccttaaacggaactagctacacattgagcacgggctacaatcctgaaagaattgctgtaattaatcctagaagagaagaaacaacctttttaattattgatttaaataattcccgtattgaggacatctctaagaaagtggagcatggaacgtttaaacatcaggctagtcaaataaaagccattattatagacaaacgaccgagtaagttaataattgatgcaaacggtattggaaaaggtttgctggatgctcttgctgataccttaaaaggaaccaaggttgttttgtccgaaaacggtgccttaacttataaataaaatacttttttagaacgtccagtgatgatttgagaaatctcgactccctctctattgctgggcgttttataaaacgtgtttttgaaccaaaattttggaggtgaaccaatgccaagaaaagctaaagaaaaggaaaaattgatctgtgctgcttgtcaaaaagaaaaggacaaagagtcggggttctataattcacgaagtagtctgtatgagaaaacaggaaaagtccctatttgcaagacttgcttgaagaaaaacattgattacagcaatattgagtcaatatatacagtcttacagcagatcgatgttaaatttgatccgttgtattgggaacaagctgaaaagagaaaaacagatacatttagtgcttatatgacaatggctaattcattgaagcagtttaacggtactggttataaagacagtgtttttgaaagacaaccagagaagccacttatagaggaatctacgcctacaaacaattctggtgttagccaatctgaaattccagatgacctgattgataaatggggtattggttacacccccgatgagtaccgtcagtttgaaagaaaatacaataaacttattcgaaattacggagaaaaaaccacacttcatactgaaggcttgctttcatatattcgtttccgtgtaaaagaggaattagcaactgctaaaggtgatgtaaaagaagctaaagaatggggttcattagcttcaaaggcagctacagatgcaaaaattaatgtatctcagttaagtaagagcgatatcagtggtggagtcgatgtactttctcaattatttgaagccgttgaaacagaattgggcattatcccccttcttcctcgtttagcagcccaaccatatgatgacgctgatctaatcatttgggcgattataaattattacagaaggctcgaagataaggaaaaagtcgattacaaagacatttaccatttttatgatgaaatgcttgaagaagacttcaaatcaaaaggattgtcgcctgaagaaattgataaactaaagagtgctcgcaacaatgttttcagagacttggagaatgtgtacaaagaacctctttatgacacaggtgatgaagattaatggctagttataaaaacttcacctcgaaaaacaagaagcacacaaaaaacagaacagatatttacgacgcagcttttgaaacccctctgaatccagatgacaattcaaacttcattggcaagaatatctccaaatgggctgagttcacctcatttattcgtttttatccagacattttttacgatatgttgaaacccgaagtcggcggaattgagctggatttataccaaagagttatgatgagaacactcagtcgcttccctcagaactacttctgtattccacgtggcggatcaaaatgtgttgcaggagacacagttttatttactgaaaatggattagtagaaattggcgaactattcaattacgaaaaaaaagagtctgaagttgaaacaatacataaaatctcaatgaaaaacagatatggtctaatggaaacttctatggccggcatatcaagcggattcaagaaaacgaagaaaatcaaaactcaagatggctatgacttggaagcaagtttaaatcacccagtattagtaatgtgtgaagatggaaaactaagatacaaaaattctagtgaaattaaagttggagatttattacctatttcaagaaacaataatgtatttggaagtgaaacaaagctaaatgtaagctttgatgatttcttaaatggatttagcaatcaaggcagatggcaagtagaaagaaacaaattcaatattccagaatacattgatgaacaattagcattaattattggttatcttcttggtgatggttgcttgactagaaacaattcaatactttttacaaatgaagacgaagatatattaaataattatatagattattttaacaacgtattaggtattgcagttaagcaaaaagatagaattaattttatcgtatttggtaagctcattcgagaattcttcagacagttaggactggaagaaaaagatgcttttggtaaggaaatacctaaaattatacttaaagcacctaaaaatattgttgcaaaaacaatacaaggtctatttgataccgatggatgtgtgacaaataaaagcgtacaattttgcactgcatcagaaaaaatgagtaaacaagttcaaatgttacttttaaactttggtattatttctttcagaaaaaaatatctaaataaaaaatttaatacttatcattataagatcaatatttctacaaagaatattgatctttttttacgggaaattggatttagttgttcaagaaagcaagaaaaacttatatcaatatgtaacaaaaatcgcaatccaaataaagatgtcatcccttatcagcaagataacattatagcaatttatcctaaaggtaaaacaagagataaattttatcatgttcttaaaggatctaatgatcttacttacgaaaaattatcactattattaagtgaaaatgagcgttttgataataaagatagcgatgaattcaaccatttagtagagctttatgattctaattactattacactaaagtaattgaaacagaagactctgagaactacgtttatgatctatatatgcctttaaccaactcatttgtaagtaatggattagttagtcataatacattgacccagatcatggttgcataccatacagctatttgctttcctaatgtaacgttagccattaccgcttctacaaaggaatcagcggtgaaaatttggaaagaaaagcacgaggaaattttaaggttttacccttccattaaagatgaaatcaagagtgaaaacttttcaaaagacagtggtcgagttgaatttcaaaacggggcgatcatcgataacctggcaaacgcccaatcatctaagggtttacgtagaagacgtggctccttagaggaatctgccttgattgataaagatttatacgatgatgctatcgagccgatttttaacatccctcgtacaaccatgactggcgaaatagatcctgctgaattaaatgggcagattaaccggttctccacatcaggatataaaaactcagatgagtacgaaaaaatccttacgatggttaaggaaactggtgatcttaaaggatcctttgtattcggatcagattggcgcattcctattcactttggtcgtcaaaaaatgtctgttattaataaagcgcgacaagggaatgtaactcgcttccgtcagaattacctttgtgactggattggtgcaagtgacggcgcattgattaatatcagtaaattgatcaaagctcggacaattacccaccctgaactttcttgtcctagagataaaaataagaacttcttgctacatgaatatgtaatcggggtagacgtagcccgctctgcggctgaatcaaacaataaaacagctatcgttgttttgaagataatcagaaacagcaataacctcattaggcaagttcaagtggtcaatattatagagccaccaaacggattgagttttaaagaacaatcaatcatggtaaaaagagttttcaaaaactatggaggaaatcaagatacttctctctcaagagttaaagctgttattgtcgatggaaacggagtcggtggcggtttaatcgaccggttattagaggatgttacggatccggagaccaatgaagaacttggatgctgggccacaataaacactgatcaaaagccagatgtcccaaattcgccggaaatcgtttacaacctaaaatcccaaggtattaaccaagacattattactcaattcctggattatgttgagtccggaaaattgaagttgcttaaatcctatgatgacatcaagaaccaaaaaagcatatctgatgatgtaatgattgaagcagcatgtattcaaactcaattgtttattgacgaagtagcaaacctcagaattaaaaagacacagaattctttcactgttgagcaagttgtaaaaagaattgataaggataggtacagtgcaattgcttatgcgctgtattacatagctttatttttagaaaaggaagaatccgatgatgagtattcatttggattcttttttaattagaaattgaggaggtgaataatgactacatctgaaccacagtcatcatatgagtttaatacaaatttagcgccgcttgattcattgttctttaatgatttatttaacggtatttcttacgacaaagttaaatcatggctgaaagaccacaacgtctacaataaacagattagggatgcctctaaattgctttataacgcaaatggtgtgtatagaaacgttattgactacatggtagccctccctactttagacagagttattttgggatcaagtaaagtagctaatttcaaatcgaacaaacaaaagttcaatctggctttaagaaaaatcggcgacaaaagtgctgtcagggatgcattaggaaaactcagcaaatatggcactggcttttattattttgattctgtagtggatgattctttccccaccactctaagtgacaatgagatcggatcaataactgaatcaaatgctattgacgactttaattgttccgtcctccctcttcctctcgattattgcaaaattatcggaaggaaaaattcctcttatcagttagcttttgatgtctcctattttgataagttcacaagtaacgggagatcgctcaagcttagacgatggccagaagaaatcagacaaggctataggggttataagaaagaccaaaatcgaaaatggttagttcttgataacaataagactattgctgttaaaggaagtagcgacattgaagatcaatggggacgcccaatcggtttatccgcatttattgatatggtttatgatgaatactttgttgacactaaacgaaacattttagatgagctcaacagcactttaatttatcagactttccctgaaggtgatcaaaaaggcaaatcagccttatctcaaaagcaacaggagcagcagcatgagaatataaaaaaagcgttagttgctaaaggaagcgttaaaggtgttaagttcttctctttggcctctggaacaaaattagacaagttggaaactaatgtagatttcttgaaggttaaaggtgaagacgagctcattaaacgaatcactacaaatttaggatttgcaggatctgctctcaatggtcaagacggtaactattcttctcaacaaaccaatatcgagatggtttcttcccaaatattctcctggttagaacaaattcaaagtgagtttaacaaggtgataaacgccaatatcatcaaagatcctcgctcttatattgaggtttactacctccctcttacccacgttaacaggaaagaaaaagtccaaaacatgaaagacctttatacaagtggtcgaggaagccttattgcttggatagccgctactggatggaatcctgatgcttacttatccctaatggaatatgaaaaagacgaaggttttgatgaaaagttccctgttcatgcgacctctttcacaatgagtaagaataacgataagtcagccggcgcacctgagatcgatgatccgaaaaatgaaaacacgattaaatcgaagacaaataacagtaacggaacgccttctggctcttgagaggaggtgattagtatttgaaaagcacgattttagaaattaacaatcagaaaaaaaccagtggtcaaacatacatcaagtgggtcgttctcgaaatccatgaaaacaatactcagttcaacaagaacggtattacctggctggagaaatacataaacgctaaccttgaatcaatcaagttaatgccaatttgcgcagaattcttggatgatgaaaacagtgagccattcggacacggtttaacagaagtcaaggacggcacccctctctttgaaaacagcgcagtggttggtacgactaccaatgcttacattgacactattgatgttaatggtgagccaaaaagagtgttaatagctgaaggcttcctatacaaccagcgctatcctaaatttgttcaatggttaaaatcaaaaatgtttgatggcgatttccctgagacctcggttgagatagcagctgtagaagattcagatgcaattgaatatgaaggtggctggaaagagcaaggacgtatacctatgaaatttgactttacaggtgatgccattttaggtattgaccctgcagacgacgctgccattttgcttgaattaaacagtaaaaaaaaggaggataatttaatgccaaaatctcaagaagaagtagtccttgagttaaacaacaaacttgataataagaataaagaaattggagaattaaatcaaaaagttgagaaacttactgaggacttaaagcaaaaaactgaagaactgaatgccgctgttaaagctgcaaaggatgaaaaagctaaggctgatgcaaaagaaaaagaagcgcaaaaagctaaggatgaaaaagccaaggcagatgaagagcttaattccctaaaggaattcaaaaacaaggcggtagccgaaaagatgcaaggagagcttaaccaagctttaaaggaatattctcctgaagaaaaggatgtcgcaaaagagaaaattgaaatgttctctaagtctccttctgtcgagcttaaaaacgaaattatttctgaaatcaactcagcaatcgctcgatccttcatcactgaacgctcaaagaagcaagcctctgagactaatagcacaaatttcgatatttattcagaagttcgtgattctgggcaacaaagttcagtgactattgatgatctttattaagataaaataacacttttataaaatttaggaggaatactcaatgttcaaattcggaacaattggtgcttataaacaagtacgaaataatccacgttgcaaggctagtgtcgatttagtccctggtctagtcgtaatccctaacgattcttctggtaacgcattccctccaggtgcatcttcaactgcaaaaggtgatgtgtatgttgttggaaacattattgataaacctgaaattcgcaataaagaagacttcaaagttctaaaaggtgaatatgtccttgcttttaatttagctgacttaaaaggactgccaattgaacttagctcagacgtagtagttgattatgatgcgcttgttaaagatgacgtattggttcctgctgcagacaaatcaggtaaatgggttaaagctggagatgacgttgcagagtttaaagtatctctaaaagtcttagagaaaaatacatttggcggaaaaggtttgtacctaacagtacaggcttaattatattctggaggtaattattaatgtttacagttgaattaaacaatgttcaaaaagactcaaaccattatgcaaatgctaaattgaatgctaagtcccctattgtagaaatcttttctgcagctgcaacaggtcaagatctttccaagtttggagcaaaagccaatgctgctatgacccatgtgaaggaactagcttccaaagctcttatgggcaaccctgtagctaaagccgagatcaacacaattgtgcgttatgccattgagcctaagcttatttcagcaattaagctatttgattttatgggcacatttagaactatcggctatgatcagcaaccaatgatgacatcatacgcgcatgaatccatccgaagccaattccaagcttcccgtggtgacgtaccgttcgctactacaacttggagcgaatacccgattggaactcaaaccatttcttctggctatgctgttaactatcgtgagattcaaagtggaaacctcgataaagtagcagaaggcatggagcaagttcaaacagatatgatgaacaaagcgatgtactatgtagtaaatgaaatgttcaatgcaattaaaaatgcaacaggtgttaaatactttgctgaaactgaaggtatcaccaaatcatctgtagacgatattatcacaaagattcgccgatttggacaaccttctattgttggtgacttttctgttgtttctcagttaaatgactttgcagggttccaggctgtaaccggagatgcttcaagcactaaactccctcagtctgttatggatgaaatccgaagaacaggattacttaacacttataaaggttcttctgttgtagaattacctaatgcttataatctaactgaattaaataaagccggcgataacttcaaaacatatcttcctgaaggacttctcttcttcattcctcaaggtaaaaagtctcctcttcaagttttccaaaaaggcggactcacatcgatgaatggtaacgacattatcactggaactgagatcactcgttttgatatggaaattggagctggtgtagccaaaggacaagaacatcaaattggtctcatcagagacacaaaatatgaattaccacaaatttaaacaatttaaaatttaggagggctgtgtccctccttttatttttggagggattacatgtcttttaatttagataaaaagattacaattaaaaatttatgtccatgggatttatatttccgaaagattgactctcacggtgacttcagattgccggccaatggaattagacagatcacagctggggaagtgcaatcccaagtctatgacaatacctcactatttactggaactgacggtcaaggtactcatgccaaaatctatattgatgacaaagaaacccgtgtgcacttaggttttgagaccgaagataaagacgacaaacaagaaattgttactgtagaacgaattaaacaaatcttgggatacaaaacccaaaaagccttcgaagaaaatgttcaaaaggaaatcttacttgagtctgaaaaagctcagctgtttgatgtagctaaaaaagaaaagattaatgattacgctaagatcaagttcattgaagaatacactgggtttaaatttgatactcaatcataagggaggttaaatcttgactccttatgaaaaaataattaacgttttccactcaatgtttcaatcaaatgaaattctccctgatggccttgaacagcagtttttcattaacgcagttggtgaatacgaaaccgaactgacagaacttggttatgatgaaaagtccaatacatttaaatatccccttacttcatcacaaattcaagttttaggaatgcttatgtacaaaggattctctttcagatatcgagacagagccttaaaattaaacaacgttgtaggaagagatgttcaattgacaggtttatctaatactaaagctcaggttaatagatcctatgaagatcttgtcgatgagattgaaaaaaaaatgagcaaactgaaagtgaataactttgattgaggtgattagatgtctatagattggtatctaacctcttcttcaaattatttgagtggctgggaaaacgaagagtttaattcaaacaagtatgaaattttcaaagaaatcttagcaaattcacctgaaacttacgacattgaattgaatggtaagccagaacaggtgataattcaaaccactcaggacagcgaaacaaaaaaagtccttacagttttaggcttattaaatcgtggagacttgattttgtatgacggtagttactggttagttaatgcgcgccccactgataacaaaatgaatgacagtgctactatgcggctttgcaattcatcaatcagtctaacatcttctgacaaacttattgattctggaaagattgatgaagttacagggagaccgataaagattaaagtgcctggtgagaaggttgacatcccgtgtgtattagaacgaacaacctcaacaattggatcagaattggctataaacattcctgaagggcaagcacatgtcaccatcccttttttaaaacatgaaaaattaaagaagggtctttttctttctttttatggtgaggaattccgtgttgatgatatagactattccaaggtctatggagacaccggaacaattagacttatagccaaaaagaaagttggaggtgatagcgattgagtatgatggttgaacatatgacaactgtatttagaactattatgaatgatacagaattgaatcgtcttttatattataaagatgaccctctctcctcttctctccctgatgttcagacgttggaaaattattatgatccagttgatgattccccatcaatattaagctcaataattaaacgtgctcccaaaactgatgatttaaccgatcaaccaatatgcagactttgtgtttatctcggcaatggaatccctaaaccctcaacccaaagtgtgatgctgctagatcaagacttgatgattgatgtttatacacacattaacacttatgaggagaccgaattcaggaacctgaaaattactgatcgtatttgtgacatgctcttcaatcaaaattttgctggcatcggtaaaaatgttaaatatacaaggttgctcatatcaaatgcgcctgaagggtacttgggatacaaattgatattcactttcggagcaagtaaatgaatgtgttaaaggattttttctttttaggaaggcctattaatactgaagtcggtgcaataaactttatccacttaagagattacccagagtacataagcgagctaaatatgatgaaaatgagcaagaaggaaatcatcagaaacttttcaaaaatcaacaatgacggttcattaaatgatttaattatcgaattgaagaagaatagtctcttcaaaattgttcatgattacttacccgaatttaaccaggcttattttaaagtgtttagcaaagtatttgtggacaaggaatcactacatcttattgatcagagagcatttaacaatgttagaaaattgatattagagatgcattgcctgactgaagagaaaattgttgagaatgatgaattacaggagtttcatgatttgaataatcaattaaaactccaaaattctcaaaatgatttaaaggacatcgctagctgtgtggctgcatttaatggatacacatatcaagaggtagccgatatgacaatttatcaattgtacctgtcatattacagaatgggtgaaataatgaattataacacttctgcgttatttgccactgtatcaactgatgtgaaaatcggtgactggaatagtcatgttgatatgtatagagaagaaaaacaccacctcagtacagcagatgctaaaaatttagagcaattattcggagactgattcacagtctctttttcattttaaattaggaggaaaacacttggcaaaacaaacagttatccatgaagttggcaaggtgctaaccaaaagacttagtgaccacaaggttgttgcatcttctgtaacacaaatgactcagttctcccaacaagtccaacaagactttttaaaaggcggatggggaaatagagacctgtatgtcatcaactcaagcaaagaggtttcaggcaacgtaaaaaatgctttctttgatcttgattttatggcaatgcagcaaggtgtaaaaattgaaaacgagacgatttctgtatgggaagatgaaagtcttactgtaagtgataccggcacaatcaaaatcgcgtatactcctttatccaaagtctcacttacaaatgaagacggagatcaacaagaatttaatgtttcagacaaaacaattactgttcctgaaacgtttgctgctaaagggaacgctgtaacagctcactatcaaattgaagttgatgcagaaacagttgaaattagtggtgaaaaattctccgagaactattacttcgaaatccacacacttgagtacgatccaaagacatcaaaaatttacagtgacctttatatccagttacctaaagttaatttctctggtgaagcagacatgtccttagaggctggacaagcctacacacctgaaattggataccgagcattagctgatgataatggcaagatcggtacttttgcccgtgttaagcgtaaccctgatgggacaaaaggaattaaaactgaacaagaagatgcgacatcgaatagcagtgtagacattggaacaacgcaagaaacaaaataacgttaggagcttgatatcttggcacttttaaacaaagacggagacatttacacttcagctagagacgatggaactggtaaaccaatcaccgatattcatctaaaatcacaagaaaaaccactacaagttgactttcctcaagctggtttggatgctatcaaaggcatccaagtacaatccccttccgtgaccttgaatgaaagagatcctggtttctcctcttttaaaacggataaattcactgttacttcaacagctcaaaaagttaccgcaggtatcactgacagaacagcacttactatttacccacctgcagaaggcacgatttacattgggaactcaactgtaactgctgatacaggtatcccattaacagccggtgacaaacctttttcagttcctgtcgccgctggtaaaacactttatgtctatgtgatcaatgacggtactgacagagacgtaagagtatttgaagctaaataatttgaggggattcttcccctctcctttttaaataaaagtcagtttttaaacagatttaggaggtggagttgttgacagaaaccgatgaaaatattttaaaaaccattccagataaagcaacctttacattccacgaagcaacaactgccccgtctgaaggtgaagaatttgtagtatcacattatcgggatattactgttaagatctctggttcctcaacttcaagagaaataaaattctttgctgtagatgaaaatggcgaaaagacagaaattgctggaacaaacaaaactgattttcaattaggtacgggtacattgaatacaaatgaaaactgggatttcgatattgcggggcttttcaaattcatggttgaggtcatttccgtaaatggagatgttacggttaaaggaattgcggtgagttaatgagcagcagtaaatttgtaggtcagctcaaacaaaacaatatacaaatcaataaccttaaagatcaatttttcagaactgaatctcacatgtctgatcatgaaaaacgtttatccgataaggtcgatgagttcatggaaaagcaaaattcagaattaaagtcgcatactcagaacatagaaaacccgcaccatgtaactaaagagcaagtcggattaccaaatgtacttaatgaagagcaagccacaaaggtggcttttgatggacatcttgacgacaagaaaaatccccattcagttactaaaagccaagttggcttatctaaggttgataatgtacagcaagcagcgaaaattgattttgacgctcatgatgcagacctggatcgacatatcacaaaggacgagcgcagttattggaacagctccgatgaaaggtcaaagtcttttttagctgaacatactaacgatcaatcaaacccacacaaggttactgctgaacaggttgggcttgggaatgtagacaatgtaaaacaagctactaaaagtgactttgataatcatctgaatgacactaatgttcatatcagcaagtctgatcgagaaaaatgggacgctgctcaacttttcaaactcactgacgatgatgggaaagtattctacaaaggtagctccgaaaaaacggagtacaatgatttgattaacactgggttttatttaatcgcaaatcaggggcttcactcccctgccaacttatccaatgtctatttagctgtcatgaactatggaactacgattgcacaattcgcattagaagcatattacggaacacatacttatttccgttttagaaagagcgattcaacatggacttcctggcaaacacatgagacgactgacggagcacaagcaagagctactaccgcactcagctcggcgaaagcttacaccgatgcccacgaagcaaaaactgatattcacgttactttagatgacaaagccagatggagtggcacgtcaggttcttggaacccagttacacttatcaatggagctacacaatactccacttaccctttcaaattctcaagtgtaaacaatgtgttatggctaagaggatctttcggaacattgccggccattggaactgcagttgctaaattctcaaccaagccaacacagctagtggattttgtagtacccacaattggatcatatggaacagcgagatttgccttcacaacagatggagatttacgttttgatggattgtatgctaatgacattaacagtgtttccagagtttcatttaatataggaattcctttatggtagtaggtgaaaatattatgcatgttctttattatgatgagaactttatgtacgctggagaagacttcattgaaggcgatgctcttcctccaaatagtacaactgctgtcccagaccccacaataatcttgcccaaatatgatcccaagaaaaataaatggattgaatcagcaactgaagaatacaaggatagcgttaaaccaagtatccctgaacctaacgattttgaaataataggacagaccctatcccaactccgcctaagcttgcttcaagtcaacaaaacaataaacacaatgttaaaagatattgctgatctaaagggaggttcataaaataactacatacaattattgggttaatgccctgagtcgaaaatgggcaaccgtcgatcaagtcaaagaagcttaccaggaattcaacgatgtgacaaaagaagagctccaattaggagtaaagaatggtttagtcactttagaagagtacaaagaaatcaccggcgaagactacgaagaagcagacacagaataaaatacaagttttatttagacacctctcccctattgaggtgtcttttttaatgtgtgcagaggatatataaggaggaaatgagatggcatcgaaaaaattaaatcttgggttgattgaagaaagtgtaagtaaatatgacaagaaagaacgagtacaacttactgaggacgttcatgtttttatttacccttacttctcccctacccgcttaaccaaaatgcttactgaattaattactgacccacaaaatgctcaagaaaaaaacattgactttaaaagcataaatcctgttcaatggggattcttttcactaattaaagaatttacagacttgggtattccaagtgatatcaaaaacaaagttaagtggtttgttaagcttgtggactctgaatttttcccattgattattagtagcttccctgaagaaagcatgaagaaatttggagaagcaacaaagatgatgcaagagaatttagacaaactttcaaacatatctcctgaagaaataaatgatctcatccttaataaggtcgaagagattgagaatgaacaagaggctgaataatggccaagaacataaaagaaatagcagcattaattgaatttgccgcaaagcaagccgttcaaaaacaatccagcacaaaaaatacgatgattaaaacgggtcaagagcatgtacaatctgatgtatatgacacatacgatcctcttgtatatgaacgtacttctcttttgaaggactcctttgtcattcaaaacgaatataacggaatttcattagacaacaaccgtgaagacaacggcaaggatgttgctacggttgttgagactggtcaagggtacacgtatccagataaatacggctatggttacggaaaacctcgcccagtcatgaagaatactgctgaatccttaaaagatggacgattagttgctgctatgataaaagatttaaatacaagtggtattaaaacagaataacggtggtgtattaatggccagaaaaaagatagcatatgcaacaaaagaaaaggtcaacaaaattaaccccaaaaatgcggaattaatccgaaagtattttgtctttaaaaacatgaacctttcggaatccagtaaagtgggatatcaatcagatttcaatcaatggctggtatacattttagagaattacaataatcagcacattgtggatattattaaagaagatcctgatgatatggttgatttaattgaagactttgttgcattttgcaccagtattctaggcaataatgaacgaagaattcagagacgaatgagtagtattagctcattctttttatttttaaggaaaaaacgtaagattaaagagaatcccgttgacttcttagacaggcctaaagctggaactggtgaaaaacttcaaattaaacagaccttcctaacaaaagaacaagtcgaagaaatcagaaaaggacttaaaaagaaggaaaatattcagttagagctcttctttgaattcggtctctcaacgatggccagagctaatgccataagcaacgttaaggttgaacaaattgactttgaaagacttcgggtggaagatgtcattgaaaaagaaggatataaagtcaccctcttcccttctcaaagagctattgatcttgttaaggaatggctggagtacagatccgaaaacggaattgaatgcgaataccttttcataacaaagtacggaggcatatggaagaaagctgaaaccggaactttacaaggatattggataaagagaatcggagaaataattgatattcctgaattacactgtcatgatttaaggcacagtggtagtaaccttctgtatcacagtggcatgagtctagaggacgtgtctcaattattgaaccataaaggcactgacgtaacaaagaatcactatctagaagtaaacaaagatgctattcaagacaagaaagcaaaatttgaagtgtaaatgaaatccctcttttatgcagaatcaagatccttctaccgaagggttttgcttatggataaaaccttaaacttatttccatatttgacgataatatggagaggtgaaaaatatgaataagacaatacttaaacacaatttagtacagatgaatagtcgcgacctgatcaaatacatacaaaaagaattcccgcactctggtgagctctacacagaacaaaagcgcaaatttcaaatcctaaaatcgctcaattcatcagatttaattttagctatttcccgtatgagtcgaattgaagcgtccttcgatcatacgaaaatgtggacagttggaagtgtgctcataggaacatgtttactatctctcagaattatgtttagttttaatttgctttggtatattctaatcgcaacatcgatttgccttctcctactttttgttgtacgaaaggatagggacattgttattactgctacatattttaaagaattacttgagcagattaagtccgaaaaaggaaagtgaccctcccctttgctagttctacacttttggaaatcatgatataatgtaggaaaataatactggtggtggttggatgggctataagattatggcttatggtggctattttttattcagccttttcttctgtttaatggatggctggagacctttgggggtttttctgataattggcggtttggcttatttagcgctcgaaccttacagaataaaaaatgcaactgttgctgaaaagattagaaaaaatgctgaaacactaaagacctatgatagcgaatttaaccctgataatttctttagcacttataaaactaaaattgcttacaatgaagataaatctatccttaaggtatatcagctaaatggagaagaaataaacgagtatgttgtcccttttgcccaaattattcaatctgaaatctcactggatgaccaggtgatttcgaaggttgccaaatcggggattattgctggaggattattaggcggcggaattggtgcaacaattggtggtttgtcagcctcctctactcaaacagaaatggtgaagtcaattacgcttaaaattacagtcgaaaacctcaaaaatcctatacactatatccacttcctcccttctcgcgaggatgatggatatgagcctcaaggttataaaaaagatgggaatatcatacagcaagctttaaaaaacgctgagtattggcaaggtgtcatggatgtaattatcaagaaaacaagtacagtcgctcaataatttgagtggcttttttatttgctctgattagccccacttgaaaggatgtgacttatttttgagtcaagatttaaaaataatactgaccccaaaagctgatacctcctcaaagactgtcgaacagttaaatcagcaaattaaatctttagagaaaaagcttaattcccttaatttaaagaccaatattgatgcctctgctttaaagactctcaacgaattctcctctgcagttgacacttaccaaaaacatctcaaatccttcaatcaaacaattaaagaaaccacaacggttaccagaaatgccgatggcactgttgaaaagctgacgcagcaatataagaaaaatggcgaaatcattcagcgtgaaaagaaattcatcgacaatcgtaatcaatcactacgtgaacaaacccaagaagttaacaggcttgctcaagcgactgaaaaactaggtcaggtacagaaaagaacagaacagaagaattctcaaggacaaacgacgagggtaactcaaaagaaccgcaatggcttcgatgatataacatatacgactgatccaaagacaaatgctacgtcatcaaaagttacaacaaattacgatcagcaacgaaaagcaattgaacaactaaagatagatttagaaaaacttagacagcaaggaattgtaactgacaccaccctctcttcccttgggcggaaattaaacactgctcaaacagctcaacaaattgaagcattacaaaacagaattaaaatgctcgatgataagtctgctgctgtggctaaaaataatgaactccgaaaaactattgagctttatcaacgccaagcacaggtaaacgtacaaaaccttaatacgcgttatggcgatacgatgggcgctggaaatagacaagctatccaagagtacctcaatgcagttaatagccttaatgtaagtgccggcggaagcaatatcagagctcaaatgcaaagcttgaacatgcaatacagggaattggcttcaaatgcgcaagcagcagctagtcaagcctcgtcttttggtgcggagctaacgcaagctttcaaaagtatgtctacatatttaatctctggttctttgttctacggcgctatatctggactcaaggaaatggtatctcaggctgttgaaattgatactctaatgacaaacatcagacgtgtgatgaatgagcctgattacaagtacaatgaacttcttcaagagtcaatcgatttaggtgacacactttcaaacaaaatcactgacattctccaaatgaccggtgatttcgggcgtatgggcttcgatgaaagtgaattgtcaactctaacaaaaaccgcgcaggttctacaaaacgtctctgacttaactcctgatgacacagttaatactttaactgccgcaatgttaaacttcaatattgcagccaatgattctatttcaattgcagacaagctaaatgaagtggataacaactacgctgtaactactcttgatctggccaactctattcgaaaagcaggaagcaccgcttcgactttcggtgttgaattaaacgatctgattggttatactacagcaatcgcaagtaccactcgtgaatcaggaaacgttgttggtaactcacttaaaactatttttgcccggataggtaacaaccgaagcgcaatcaaagcgttggatgaaatcggaatttctgtaaagactgcaggcggagaagcaaaatctgcgagtgagttgattaatgaggtagcagccaaatggaacacattaactgatgctcaaagacaaaacacctctattggcgttgcaaatatccatcaattgtctcgatttaatgccttaatgaacaacttctctatcgcccaaaatgccgccgcaacagcttctaattctgcaggtagcgcttggagcgaacagcagaaatacgcagatagcttacaagcaaggttaaataaacttcaaaacaatttcactgaattggctatagcttcatcggatgcctttattagtgacggattgattgagttcactcaagctctgggttctttgttaaaagcctccactggaataattaacactgttggtttcctccccctctttttgtgacgattagcactgctacattgttactcagtaaaaacactcgaactttagctacaactcttatattaggctcaaaagcaatgagacaagaaaccttagctagcatcggattagaagcaggtatgacccgtgctgctgttgcatcaagggttttgaaaactgctcttagagggcttttagtttctacagtggttggaggcgcgcttgctgcgttgggttgggctttagaaagcatagtttcatctttcgcagatgcaaaaaaagctaaagatgattttgaacagagtcaacagaccaatgttgaagcaattacaaccaacaaagactccacagacaaactaataaaacagtataaagagcttcaaaaagccaaagattcaagaaccctttcatcagatgaagagcaagaatatcttcaagttactcagcaattggctcagacattccccgctttaattcaaggttatgactctcaaggaaatgcaattttaaaaagtaataaagctttagaagaagctattgagaacactaaagaataccttgaacttaaaaagacggaaactaaagacagcgccaagaaaactttcgaggacgcttctaaagaaattaaaaagtctaaagatgagttgaagcaatacaaacaaattgctgattataatgataaaggcagaccaaaatgggacttccttgctgatgatgaagattataaaatcgctgcagataaagcgaagcaaggtatgcttaaagcacaatctgacatagcaagtggaaatgcaaaggttagagacagtgttctctcaatcgcccaagcatacagttctatagatatcagcaatactttaaaaacgagtatcaatgacattgtaggtaaactcactttaaaagatgatttgaatcctgatgatctcgataaattctcttctgcattgggtaaactccaagagaaaatgcaatcggcattgaattcaaacgatgaaaaagcatttgatagcgcgaaaaaggatctgcaaacccttttggagacctattcaaaatccagttcttctattgatgtctttaagttgagttttgataaggcacaaaagaacattaaagatggagataaggccatttcttctgttaaatcggaagttggtgatttaggggaaactcttgctgaagcaggtaatgaagctgaagattttggtcaaaagctcaaagaagcgcttgacgcaaatgatatcagtcagattaaagatgtaatcaaaggcatgtcagagtcaatgcagtttgactctgttcaaggcattcttaacggggatatttttaataacaccaaagaacaagttgctcctttaaacgaacttttagaaaagatggctgaaggaaagagcatttctgccaatgaagctaatgctctaatccaaaaagataaagaattagccaaagcaataagttatgaaaatggtgttataaaggttaaccgagatgaagtaattcgtcagcgaaaagttaagctcgatgcctataatgacatggttcaatatagcaataagctaatgaaaactgaagtcaataatgccattaaaaccttaaacgctgattctttacgaattgacagccttagaaagcttcggagagagcgtaagctcgatatatccgaggcagaattgtctcagctcgaagttaaatcaatcaataatgtagctgatgcgaagaaagaattacataagattgaagaaaaaatgttgcaacctggtggattttctaacagccaaatctctgcaatggatagcgttagagctgctcttaaatcctacatctcagcatctgaagaagctacatctactcaggaaacaaacaaacaagcgttaatagaatcaggtacttcccttgaaaaatggacagacgagcaagagaaagcaaatgaagaaaccaaaacgtccatgtacgtggctgataaatacaaggaagctctggagaaagttaatgctgaaatcgaaaagtacaataagcaagtaaacgactatccaaagtattcccaaagttatcgaaatgccctgcagaaagaaattaaagctcttcaacaaaagaaaaagcttatgcaggagcaagccaaactcctcaaggatcaaattaagtcagggaacattgcacaatacggtatagttacctcttccctttcctctggttcatcttctggtggttctttttcttctggtggtgggtcttactccggtaaatactccagctacattaattctgccgcaagcaaatacggtgttgatccagctctaattgcagctgtaatccaacaagaatcaggattcaatgcaagagctcgctctggagccggagctgctggtttgatgcagttgatgccttccactgctaaaagcttaggcgtaaacaatgtttatgatccttatcagagcattatgggtggcacgaaatatctagcccaacaactaagcaaatttggtggcaatgttgagaaagcacttgctgcttataacgcagggcctggtaatgtaattaaatatggcggcgtccctcccttcaaagaaacacagaattatgttcagaagatcatgtcaaattacacgaagtcaatgacttctgccaattcctccattgcaagctactacacgaagaacagcgcgtttagaataagttctaagtatggtgctcaagatggcgcttaccgatcaactccacataaagggacagactttgccgcaaaagccggtactgcaattaagtctttgcaaagtggtaaagtccaaattgctggttatagtaaaactgccggtaactgggttgtcattcagcaggatgatggaaaagttgctaagtatatgcatatgcttgataccccttctgttaaagccggtcaaactgttaaagctggccagaccatcggtaaagttggcagtacgggtaattcaactggaaatcaccttcatcttcaaattgaggaaaacggaaagacaattgaccctgagaagtatttaaaaggtgtcggtacatctatttcagatgcgtctcaagctgaagcagaacgacaacaagcaatagcgcaagctaaatccgacctcctctcccttcaaggtgacattaattcagtaaacgatcagatacaagagcttcaatatgagatcgttcagtcgcatcttgatgaatatgacaagcgcattggtgattttgatgtaagaatcgctaaagacaaagccctcgctagtcattatctgagcgatagtaaagagttccgtaagtatacaaacgatcagaaaaaagctttaactgaacagcaaaagattcagagtcagaaggtttcttttattgaaaaagaaatcaaaacaaacaaaactctgaatgccgctcaaagagcacagcttgctgaggaattaaaacaagctaagattgatctcatcaatttccaagaagaagtaagagaacttcagggacagctcatccaatccaaagttgatgaaacgcttaacggtatagagaaatcaaccaagaaaactgaatccaagcttaaagatgttagcaacaaaatatccatgaccgaggaagataaagacaaggttaaatattatagccaacagattaagcttattcagcagcaacagaatgaagcgaagaagtatataaaacagttggaagcacaaaagaaagctgctaaagggttcccggatattcagaaacaaattactgaagaaatcgagaactggaaagacaagcagaaggattacaatctggagctttacaacacaaagaaatcaatcaaagatgtgtacaaatcccttgctgatgaagttgtctccatctataaagagatgtacgaaaagatgcgtgatattgaattaaaagcgcaccaaaaagcaacacaagacttgattgatgagatcgataaaactgacgatgaagctaaatttcaaagacagttaaaagagaagcaagagagtatccaaaaactcactgaccaaattaatcagtattctcttgatgactcagaatttggtaagtcaaaggttaaggaattaactgagcagttacaaaaggaacagttagatttagatgagtttcttaaagatcgtgaaagtagcaaacgtaaagaagcgttgcaagatcagcttcaaaaagacgaagattcaattaacaagaaatatgatgatctcgtcaatgatgagcgtggatttaaggaacttgagaaaaagctaatggatgggaagattactgatattgctaagcaactgaatgaattctctaaattcattaacagcaatatggagtccattggtaaaagtatctctaataaccttatcgataagcttaaagaagcttctaatgcccttaatactgtgaccaaaggcaatacaacaggcaaaaaaatatcttcatttgaaacaggaggatacacaggaacaggtttaggtgctggcaagcttgctattcttcatgataaagagcttattctgaataagactgacaccaagaacatgcttgaaactgtaaagtatgttcgcaatctgtctgataacgatctgaataatgaaacacctaaatgggggcaaggtggaaaattagcagctttgattaacaaagggattacttctattccatcaataattccgaatattaaccaagcgagcctatctaatagtttgataccaaatgttaagactgctaacctgccccctaccacaaccgttaattctaatggtgataaaacaattaacacaccaataattttcaatgttgataaacttactggtggggaaactggagccagaacaatgctcgaaaccatcaagaaagaagttataaaattaaatggaagcatgtaagagtctgtataatgcaggctcttcagcttgctttttgattggtaagggtggaattttatgattagagaaagtcaatatttcatgttcgatgatatcccctcttatgaaattggggcagtgaatgtaaacacagagggcggactattggaagagaccttcgtagcgaatagaacagtaaatgaaacatatacacgatcagcttctgaaccgtatgtagacagtgttaaacgtgaaccatatgaaatccctttaaacttttacatagaagatcatttagatgaagaaaatattcgaagagttgcacgttggctaaatgtagatgattataagcctctttcattcagtagtaatttagatatcatttattttgctttgccagtgaatgcaacagatttggtacacaactgctctaatgacggatatgtgaagctgacaatgaaagtatttccttataggtatggacgagaaacaactacccattggtatgacatatcatcaggttctaataatatagaaattaaaaatataggggatttagatatcccactctctcttgaattcaaaaaaatcggtgatggagacatcacagtcgaaaacttgacagcttataaagaacctctaaaattcacatcaattaaacatcaagaagttattaatgtagatgccaataaagagctgatcacctccagtgttactgggtatgagtgttatgatcaagtcaatgaacagtatgtttttttaacaagggggataaacagagttaaaataacgggcgaatgttgtatccggtttatatacagatataagtatttgtaaggggatgttttattgatttacgattttaaaccaggccatctcaaggtttctttagcaaaaccaaataaaaagaaaatcgctaatatagtagatttctctaacgcctctctaaatttgaattttgatgaactccacgatctaacttttaatatcccacttaaagcaagatataatttcaagatgaagccaaaccatgtggcagaactcataaaaggctggtatctcattaaggcagagttcttaaacagagttgaatggtttgtaataaccggattgacaaagtcagaaaatgaggaacaaacaatacaagttagagctcaaggacttccctacattcttcataaaagcaaaatcaaatcatatgaaggcatctctaaaaatctgttggaagttgccacagattgtcttaaaggaacttgctttactgtagactttattgacccctcttttaatgaaaaacgccgctcatttgatgttacctctacccgatatgagtttttaaagaacattggagaaacttttgaggctgtgcctatatttgatactgtgaacaacacagtatcattttataaaaaagaaactgtgtccaagtataaaggtgtccaattctctcctaaaaggttcatgattgatatggaagataccattgatattgatgaagttgtaacacgattagacattaccggtaaagatggaattgttattaattcagtcaatcctactggacaaagttacttggatgatttctcttatttcctctacccttttgaacgtgatgaaaagagaaatgtaattaagcatagtgattacatggatgatgatttgtgccatgcaattttagattacaatgaacttgtaaataaagaaggctcttctttttacctccttttaaatcagaaaaaagatctggaagcaacaaaaacaacacaggagaataccctcttcaccctagaaaaaattgaattacaacaaatcttagataagatcacagtagcaaaaaaagctggagatgacacgaaagaccttatcaagcaaagagatgccaaacaacttgaagttacatcaaagaaagctgaaatatccaccactgccaatcagatttccaagataactgaagaaatagcagtgttaaaagatcggttatctatggataagtttctcggtgaaaagctaatgaaaaagttgtcttattttatccgtcaagatgattggtctaatgacaacatttttgatgaaacagagctgtatgaaaaaggccttgaggaacttggggagaaaaatacacctccggtagacatcagaacaaacattgtcaacttattcactgtcaacaaagaaaaggatttttgggatagaatttacctgggagatataatcagattagttaatgacgattttagaactgatgtcaaagcaacacttacaggaatgaattttgattttgagcagcaaagtatacaagtaacactctcgaatggaaaaagagctactacgatagaacaagactttgcacgctcattgtatactgctaagaaagcatcaactgaattcaataagaaaaagattgattatgataccctactgaccaattacaatgcacgaaatgatcgtatatctgcacccgtagcaaacccaactatccgaaatgacgggactgctataactcatgttgtaaatgataatggatctgtagatgtatcaattgaatgggattttccagactccgatgaggataaatacaatatcgatggttttcttatccattgctactctgacacatcagatgatacctatctttttggtgcaaagatgtcagctgaacaatatttatcagttagttatgataaacgaattgcaacattaaccggtcaagtttcaaataaacactatacatttggagtccaagcctatcgcacagtagagacgtccattgatagcagtggtcgaatactatctgatattgtacagcctaaattcccctcagaaaacccctacctcccctcttctactgtagaagtcaaaggtaagcttaatggctcgaaatacactgtctcctcaactgaacccgaagagccagaagcaaacgatttatggactaatacggttaccggtgttgtttcctcttatgacggcgaaaaatgggtttccagtgaccagaaaactgctgagttagttgaaaccacagcagcacaagttgacactaaactctccgactatgatagtcgtgtccaaaacattgagctcaataaccttttggtcaatcccctgaaatggaaaggcggaaatgtttctgcatttggtcgtaaatattatgctgatgttagttatgactcaactgttttaaacttaaatacaatcactattcctatccttattaatgctgtggatgcttcagactcaaatccaactgttgtggattacacttataacgaagcgtgggatatgatccctaaactcaaaaatgacgggtacaacattattttagaaccctaccccttcatcgcaaatggaacgatagctgaaaccgattgggcaccttctgatctagaccaatggttcgtagcatggaacaacatcctgcaagacttcgctaaaaaatgcgaacaatttaaattagacggtttatacattgcttcaaacctagttcatatggaagactcaacagaaaagtggaaatcagttattacaagcgttaggagtttattcagtggaaagatgctctaccgaacaaattattgggtaaccgctgattgggctcccgaaacgattgctgcctacaacaaaaagctgaataatcctctattcggactagtcgatattattgcaatagcggcttactttgaattaactgataatcgaaatccatctgtcgatcagctaattgatgctatttatagcgtaccgttatacggacgcggacaaaatatattcaaggaaatcaaagcattttatgataaatggaataagccgatcttctttggtgaacttggcatcccaccttacagtaactctcctgaacagccccataacgcattcggtgacctaggggaatacaatgaatcaattcaggcgaattggtttgaagcatgggttagagtttttcaagctcaagattggtggcaaggatattctgtatatgcaatttcagatgagaagtctgtttacaacgtaattgacaagaaagctgaatccattattagaggacaaacattaggtggtactaagggcagactgcagagtttagaagagagagtcgcgcacttagaagaattgctcaaatcaattacacaataagaaaggacggtgaatttagtttggattttcctcagctctataacgaccctaccctttctcaaaaaaggaagggttcaatcgatgacccttatttaagctatagtgaaactttaactgtttacaatggtcgagtcttacttacagaagtacctaaccgtgagtacagagtcgaggttagtggtgacagtaaagaatggcgagaaattgaagatggtgaattagaagacaactactttaaggttgattaccttatgggagttgtctttttcaatggttcaaatgaaggcaaatcacttacttttgcatatcaaggagaaggcgcatccttcttccctgcctcaagaatttggattaaacgacaaggaaatatggtcattgaaacgcttcaaggcttaattgatgatgctgaagatgccattattcgtatcaatgaacgtattgctgaatgtgaacgtgtcaccaagcgctgtattgaaataacaaattggtgcagacaagcaacatcagattatgagtatgtagttgagaatactaggaagatttacttgccgtttgtgtacacctatcaggatttattgaacacttatccttcccctcaaattggttggactgtcactgtaaaagaaacaggcattgaatatcgatgggatggtttcgactggataaatattagcgtgtcagataagtatgatggtttcaacattgtttctagctatgtagagccttacaacatcagatcagtatggttgagaacgaacaatgctcccaaaaagatgaggataaaaccatctgtagaaccccctgacggaagcatggtttggattagaaaaggataaggaggagtatatattgagcgacaatttaattcccgtaaacacaatgggctataaggacgaagaaacagagcaatggatacccattgatgccatagggttaaaatcaaataatattagatatactgcagacgatattcaagaggcttttgataaagcttctaaggatattaaaaacgtaataagcacagtcgattctggtttaacagatatcacaaacactattggagacatttcaaaaatccctgcagctggtgcaacaattgttgataaagtcttaaatgagtttatcagacgaagtgtcaatgttcaggattttggagctaagggtgatggtgttactgatgacactgaagctttcaaagctgcctttgccagcgggaagcgagaagtttttgtacccgcaggtatttatatggttcaaggattacatatcccttcttatgtcagactttacggtgttggatcaggatctattatcaagcttcacccaactgctaccggaacatcttgtgtgttaaccaatagcgactacacaaacggaaacgaatatatcttaattgaagacttagacctcgattggaatttagacaaaaaggacaacaccattacaaatggaacaaatgcaaactgtgtggggattgttaactctaaatttgttcgggttagaaacgtcaatgctcgtaatccaggtgtacacggttttgatgtaagctcccctgtttggaactcttcttctgatggagcagatcattatcagccaaatggtagcaaatatgtttggattgaaaattgtactgcaactaactatggtgatgatggcttcacaactcactattcagactacatcttcttcactaactgttacgcctatgacgctaatggatccgcacacagcaaaggagcttcaaattcaaacggttttgaaattgatgatggctctaaaaacgtatggcttgtgaactgttacagccgaaaaaattgcaggggttttgaagtcaaagctcacaatagagcacctgcagcaagaaacgtaaacttaataaactgctattccgaaaatgatatccgcgctttcgactttagacatattggcttccacctagcctccgaaaaaatctccacaagtgcatttgacattaatgtcgttaactgcactgcacaacatcctattttcagtgacctttatcaaggtttaaatcctcgcgcactagtcatttccgcttatagaaatgtcaacgtttcgaacttcaacgcaattggtgatccaacctatgattataaaaacactgcaatcatcaccacccaatataaaagcaaaaatatcaacctaagcaacatcactgtttcgggatttacaacagcgagtaacgatatctatgtaatcggtggagctcaaaaatcagataatgtaaacatctcgaatgtaaccattaaccaatctgctttagttggtattgctgtgggaagtaaagttggctcagtcaatatcaataacgttaacatgacgggatcaaacaaagcaggttcgataggtgtttactgcacgaattcacaagctaatattagcgctgcgatgtgtgaacaatacgctactcccagtaaaattgccggaaaaacctacacgtttatcccgaataatttcaagggcggtctacgtggggctacgacttctggctatgctaaaacaaatactagtgcagtattagcttcatcgggtgaacctcaagcacttggagatgccactttagttggagctactaccggaggatgcgttgcaaagggaacaagaaccaacgttttcggctcatcaggcggaagctctgtagatggatctcgtagcggtgtttacaactccaatgattctcatatcgaggggcaaaatgtatcacgtgaaatccacgcttctggaggtgtaaaacttggtgaaaatgatcgctatatggtggttggcggatatggcgctactccgtccagagcaaatattaaatggatgctaaactccatgaatggggatataacatcggcaggaaagatgaatggcggagccacctttagtgattacgctgagtattttgaaagtcttgacggaaaagcaattccgacagggacaattgtcactcttgaaggagctaaaattcgcccggcgagaaaaggtgaagatgtacacggagtaatctctgaaactgcaggaactattctaggaggagctgatattcactggcaaggtagatatttaaagaatgagtttggtggatacatatatgaagatgtggtcaacccagaaaccggtgatgttaagaagctgcctaaagtaaaccctgagtggattgaaaaaatagattacgtccctcgtgaagaacgtcctgaatggaatatagtaggattgcttggacaggtttatgtgaaagtggacagtactgtttctgtgggagatcgaattgaaggtaattatggaatcggcacaaaatcagaagacaggttttactcttggaaggctatggagattgtaactccatattcagacaagctcggttacggcattgccatctgcttaattaagtaacccttaaaattaaaggaggtggttatgttctagttaaaatataaattttattcaatttacggcattcaaaaacagagataacaagagcatacgtgagataaagagagatagggatttgtccccttctctcttttttgtgctcaaatttaatttaggagagatgtttaatatggctattcaagcgagacaaatgttagtatcaccagacaaatattcaatcaaatgtccatatgcattatctgcttcattcatcacttttcacaatacatacaacgacgcaccagcgcaaaatgaagttagttatatgatcggtaacaataatgaagtttcttttcactttgctgtagatgataaagaggttgtccaagggattcctacaaatcgtaatgcatggcatacgggtgatggatcaggtgtgaattcaggaaaccggacttccatcggtgtagaagtttgctactctaaatcaggcggagagcgctataaaaaagctgaagcgttggctattaagtttattgcacaactccttaaagaacgtggctggggcatagatcgagttaaaaagcatcaagactggtctggcaagtattgcccacatcgagttcttgatgaaggacgttggaatgctgttaaagcttctattgctgctgaattgaaagcactcggcgggaaaacttcttcctcatcttcaaagccaacaaaagtcgttaaaacaaatggctcttatgttaagaacacagttatcgcagacagtcttaatgtgagaactcagcgcaatgcgaactcctctattgtacttgcccttcctaaaggctccactgtccaataccaaaaaggatcaactcaaaatggttggggttatatcaaatatacaaactccaaaggcgctacatacagcggatatgtaaatgtgaaatacattaaaagtgatgctgagcttggaaaatcaaccccaaagcctaaacccacttctaagcctgatagcagtggaatcaaatctgtaggcaagattaaagttgtcggagtaaaaagcgctgctatcgtaatggacagacctgataaaaacaaagcgaagaatctcggcactgtggagctaggtgataccgtcagcatttctggctcagtgaaagggttaaacaatgctaagggttactgggaagttatctacaaaggtaaacgaggctacatctcaggacaatttggctcaaaaatctaaatatatttaaatatctttgagaatgattgtagctcaaagtgtatcaatgattatttaggaggtgatgtgacattacctcctattttttatggaggatgattgcattgtggctgaaaaagaaaactatgaagttttaaagaccgaggtcgctcatataaaagaacgtcttaaagaacaagcagaagatagaaaaatcatgttggaaacacaaaaaacaacaagtgaatcgctcattaggcttaccactgttgttgagaatcaggaaaaaaaccttgttgaaacaaaaaatttgttcaccactgagatagctggactaagaaatgagtttcagcaagttaatcagtcgcaaacaaaatggcttcaaaacttattagaaggaacattcggcaagacattaaagattttagttctaattattctcttactgcttggtgcagagatcgctggtgttgatatcaccaaattagctaatttataaggagacgatttaatgactaaaattaactggaaagtaagacttaaaaagaaaacattcctggttgcaatcttctctgcaactcttttgtttgcacaagcaattgcatctgcatttggatacgacatttctgtgtttagcgatgatcttactgagaaatttaatgctttgcttacatttctaactgcaatgggggttgtagtggatccaaccactacaggtatctcagacagcgatcaagccatggaatacacagagccaaaataacttggggagtttatctccccctttttttcattttcaagaagaaaggaatgattgttgattatgcaaataggatctggatatatcggaagtccaatgcttgagaagtcagaatctaaccatgaagtaatcccctccccacctgcaacctggacgattaaatattctttctataagttcagcttttcgaatgatcagaaatgccacgtatcaatcaatggtggagatcctatctatttaagggctggacaaggctttcaaatggacgctcacgattcacctatcacaagcttcaaaatttctgagtcaggaattacatataactttttgggggcgcataaatgagttttttcaatccaatggttaatgtctcaattgtcactgggaagtctgcttatgaaatcgcagtggacaatggtttttcaggaactgtagaggaatggttagcttcactaaaaggtgaaaaaggcaacactggagctactggcgctaagggagacaaaggtgatactggtgcaaccggtgctaaaggagctactggtgctgccggtaaagatggaaaatcagcatatgaattagccgttcaacaaggcttcactggaacattagatgagtggcttgcttctctaaaagcaacagcaaactgatcatatacccttctctaacgaggagggtatttttttcgtttcgttcataatcgaattattgatttgtttttaattttcactcaaattccctttacatttctttcctccaatgcaactatataataaaatggatttgaaaggggtttaggacttggagaacgaaaaggtcattccttatgatttagtagcaacaaagatgaatcattggtatgtggctattaaaaagaattgggtcggtagagcagaagaaatgcgtaaagaagttatgcaggaaataaaaattatggaagaaaaccaagatgttttactatactactccctacttgagtttagacataagctaatgttggcatatatgtatcctaacgctataaaagacattgagaaaaactatggtgagttaaaagcatacgaaggccatgaaaacttaactggaatgctcgaatattactattattttttcatgggcatgttctattttagacaaaaggagttggcattctcccttaatcactatagacaagctgagagatatttggattcaattgagagcgaagatattgaagttgaaaaagctgaattttattttaaattgtcagaagtgtattaccacatgaaacagacttatttttcaatgaattatgccatgagggcttacgatatatttaaaaagcaacctgctattgacgggagccctacatacggggtacaaaaggtacgctgtcaattcgtcatatttggtaatttattggacagtatgaagtttgatgaagctttaaagcaagcatacaaagcgtatcaggaagcagtagagctaaacaaaagtgaaaagaatcgtgggcatttgatgcgttcagcactgtttaatattggattatgttataatcaaatggaagaacttgataaagcattttttcactttaataagtcacttcaaatcattgagccggaaaatcatgattacgctgctaaaacattatttgttatctccttcttaaagggaaggcaaaatgacattgaaaacgcaaaaaaattttatgaacaggccaaacagttggctgaacggcataacaatgaaatggtacttgaaaagttaaaaatggttaaaggacttttcttggactatgatttagacttagttaggaaaacattcgagttcttcaaagaaagaagtatataccctgacatggaaagctatggtgtctctgtagcagattttctcactggaaaacaggatgcttggggtgcagttgaattttatcgtttggcaaatgaagcaagaagacaaatcaaaaggggagaagcaatatgaaaactaaactatttatctgtgcagttctattattcggcgttgccggaacagtgggtgcttcctatctccaacaacaaaatgatacgttcaaggttgctgaaagagccgaaacgtaaaaaactaatgactttgtaaggagaacagagggagctgctctctgttctcatgatttatgtccacccgtcaaacctgctctatgcaaagctgtgcctccaggtgtataagaaacagctcgtaagatcgctttagatccgtatttgtttcttatcccgtccataacgaatccaagctttcttctcttctcattatctttttcaaacagacttaattgttgatttacatcatcctcaatattggataaggtaactgaaacacttcgtaccgttttgcctgtatagaatttatcaaacaacatcaagcaatatcgataaatatccattgtgatatttgtaggcaaatcaatcgttttagctctgtgaaagccgccgctgaactcatctttactgtaaccaatacccaagctaattgtgcgccctactttgttatgtgttcgtgctcttcgtgcaacctcttcacaaatctccaagagaaccgccttgatatcctctttcttcgtatagtctctaagtaatatctgacttttcccgtagcttatttgcccttgcatcaaaggagctccaatttcagaaaggtcaattccatgtgcatgataataaagctgattgcccataatgccgaatcgtttttcaagtagctctaatggatatttagctaattgaccaacagttgaaatccccatccggtttaaattcctctccatcctccctcctattccccacatttcagataacggatgaacacaccaaagcttatttggaacatcttcatatctccaccgtgcaatcccagtctttgttttcttactctctaaatcaagagctaacttactcagcaacatattgtcaccaataccaacagtacaaactaagccaaactctctcttcatactgctctgaattgcttctgccatgacttcaggattttcttttcctgcatctaaaaaagattcatcaattgagtacgtgtgcacacatgtttcaggaacgaacctgtaaaacaatttagtgatttcagttgaaactctgatgaaaagtttcatttgcgggtttactatatgaatttttggatcatctggaatctcaaataaccgggagccagtcttgattccataatcttttttaagtgcaggagacgctgctaagacaacacttccctgtctatccgtgtttccgactacagcgagataacatgtcattggattcaatcccattgttacagctgaaaccgaagcataaaaggatttcatatctacacaaagtatatttttacgtggaaactgtgagtaatcaatcattgtaagcaactcctatgatgtcattcatggtgatgtatacggtttgatcatgatgatcttttacgtgtaatttgtgttgttcgtaattgagatattgaactgtaccgattaaatcctcagcaaccccttctttaaagagcttaaactttagttctttattcaacgccattgcttcagaaaccaggatgtcaatctcctcaatttgttgctcatctaaagatggcttctccattttcgaaacatctaacaagtcctgttttaattgcgttaaatgttctggaagcatcatggaagtccatttgatcgcccctcgatctctaagcattttgaatcactcctttattgatctaatattaacagaacaaatgttctttattcaatataaataagaacaatagttcgatgtaattgttggaaatgactattcagcaagtatccactaagctttatgggctgctctagtcgatacttgagttcagtttcaagaaatccgcaggaaaaagtaaaaacagccgccagaagaaaatgcggctgtgtgtctttatttgtctttctcctttttttcattcggcagctggatggaaggcgtcacacctgatccgccgcttccgttataaaactgcggcacctctccttgaatcgctttaatggagaccggaatattatttgtcacgactgatgttttactggcaaacggaataatgaccttcactttaatttccacaaaaatactgatatcgatcagggcattgttaatgccgtacggctttatttttgttttcacatcagttaacgcatcaccgatcaggttaaagcgcacggggattttcggccccagatttccgagaatgctgtttcccgtgacctgccctaaagggatgttaatcataatttcatcggccgttttcgcgcctttttccgtttcatgctgcttattgttcgactccgcttccttcaaatgagcctgaagctgctttgtcactttcgccttcatactgttgaccatttgtgtattaaaatccatcgttgtgacttttccgttttcatccgttttcatatcgaccatatctttcacattgtcgctgtgagacatgtattcttcaatggattccgtaatgacctctgtcgccacccgtttggtttccatttctcctatgttcatcagcaccggtttgattgaggagttgatcatccagaggctgatgaccgtcgatatgataaaaaaagcaaacgacagaagcaacacataccgaaaaggcaaaggccctctcttgcgaagagcgctccggtatctaggcaagaaaaatccccccttacatatcacaatgtatgcttgtaagggggacatagtaatttattttcacacttaaaaactccggcacaaagtattgcttttctttctgatcacgcaaatgacgggctatttttatagcctgcttattttcgtttttctaatcctttttctttttatgctttcttttgaaattcccttataaatttgatgtgaattttccatttcattgcttagctcttttgtgttttcttccatcataggaattcttgtatttacaatcttagatagttcctggttaaattgtttcatcagtttagcttggtctttaagatttacggcaatgtcagtatatagttctatttcattaggatttaccccatcaatgacagctttagcataactcctagcagcttcatgtgggtctgcatatgtaatgcttgagccattatgaattagcaaaatttctttcttcatgataaatttcctctcttgttgaaaatcttaatatatcttataacacaaatttcaaaaagaaaagtactacattataacttgtctattgtcaataaggctccaataatcacagacatatatttggaattagtgtataatgattcctgtacattaaagcatgctcactcaagggagtcttgctcatcccctacgaaagggggtgatgcttatgtcaacatttcaggcattaatgttaatgcttgcattcgggtcgtttataatcgccctgttgacgtatataaataaaaaatagacctcccttgagcctggaaacctgaagggttaggcctatcatgaacaactgctgagcaagccctttgatgggcagctttttgtacagagccggggtgctaccaacaccctggtctttttattttatgcatttccacaaatcaaatgcaaaaaataattatataactgtatcatctacactaattataaccacataaaaatggtatttgcaatactattgctttatggattaaaccactttcactttgcctaaggacacttatgctgctacatcatgcaattgcaatacttttgcttaactgtttaataaatcatcatctagctcaatagataaaataccatcgtcttcatctgttgtctcttcaataaacagactttgaatgaagtcagagaaagaatttgcgaccaaaaatgtgtcttttattccatttgtcaattcatgatcccaaaaataaacttttcctgttgcttctcctttcacaccaagacaaatttgatctcctccgtcaccatcagcaatcggtataatccagtccggcatttgttctgaaagatcctcttttaatttgataatattagcatcattgttattaagaccgtagaaatatcccaaccggagattaccgttatctgctagtggattgtcctctaaaacagggaaaaacacattatcttcctctatccagcattccccgtataaattgagaaactctttatattcatctgttatgtcgaaagaattttcgtcctcaaactttttaaggacttgatgagaatttatgttcttatcaagtcttatatctaaataaaattcactcatttttttcttgattgcctgtatacccattaaaatcctcctcttaaatcagatgccgaacctacgtgaggtatattaccatgtaaatccatagggattaattggatggtgttattgtctaaatgatgcggtgttaatctaactacttctttcagccatttttcagcttctttttgggttttaaagcctttcattttttgaatacgtttataaactgctggaaaatcctttttagtacctttcagttctcctgatttaaacttaatcgtccctttgctccatggtgtaaaaaccggtctgccatctataaaagtgacgggttctcctttagtaactgcattaacgtcaggtctatctgagtgccatttaccgttaccaggagtcccttcccatctcccatgatttctaggcaaccttgttctaggattggcggactttattaactgaagcagacgatcctttaaattctcaccgttaactacattataaggaactcctccagccggaacaacatcgtaacgtggattataaggcaataaatcagcaattgagacatctttcagtttttggcctgctttactgactttagaggtgacttttcctgctacgtcagcttttgtaagagaaccggctccctttgtgcctactacagaggtaactaccgtacctatcgcatatgtcacccatcttgatctggagtaagcatctccatttaccatatctttttgatacgattcctcaatagctgttgaaatggaattatacgtgttaatcggatgagcaactgcccctatgataccttcaacaacttcatcaggcttgctgatcagctgccataaacctgttaccgtgtctttcccgacatcatataaaccaacgccggctccttttaaaatatcccaagtcacttctccggcttcttccatctgttttgcttgttcaagctgcatcacatattgttgttgggaaggttcaaggttttcatagccgatcttcttcgcgatttctaaatattcatccggatcggtcacaccgtcagcgagctttttcttcagatccttgatttcccgctctttcgcttcttcctttttaatcgtcaaataagcatccgaatgtcttgcaatctcgccttttttcttatgtatgtcactttctctgtacgccttggcgttatagtgaagtggtgttgcgtttttccctttacccgtggcattttgaagctgttgaaagtcggcttggatgaaatgctcgttcgcttcggtttctgcatattccttcgttagatcatgatcgagctttccgagcttgtgtatggtattgtcccgtttcttatctgctgaatccagcttttgatcgacatcctctgtagagaaaacatcaagatgaacaatatcacttatctcattaagaatatccctcatttcattccgttgctcttgcatgatggcttttgacttattcttcgcatgaatcaactcatgctctaaaaatgactcttccacaaacgaatcggctaatccggcatcagctacttttcctgaaatactgttaagaaaagcaatcttcatatcgatcagatcaagccagctgtctgtaacaccagcgtgatcttggaagaatgctttaatgttatcagcacctttacctgaaaactcgctgtcatctaaatcagccattccttgaaatgcttttctgagattgataaattgttctctaatctgatcgtattcttttgctcgcttttccgctgctgagattaacgaggatgcttcaaataccttcatatctgtctccttcccactcaatcttatctaaattttaccacataaaattacatgtaaggagagcttcttccttttgtcgaaggtctctttcttaggagatttgaactttaacaaaatcttaaaataggcttaattcagttgataaaaaatggaaaaggtgatactatcctcgcggaaggaggtattaattgtaaaatatattatttatttacatcttagatactcatagcaggtttaaacagaagaaaaaggagtgtaaaccattatgaagtatgtgtcaaaaagcatttggttagttgtaatagctctctctttattattctcttgctatcccctccatgatgtaaaggcaacggcaaacaaagaaatcactgataataatgcaactggcattgacctaaacaaacgtatctcaacagtaaacgaaaaaccgcaaaacaccgattcctctaaaagagaattagctggatcagaaagtaagttgcaaaaaattgctaaggaacaaggaatggatgttgaaagttcatatcagacttatatagcttatgacaaagatggtaatcagacatcatctggacaagtcacctctgaaaaccaacggaaaactgttgagaaaaaagcaaaaagtattatctatttcagtcacacttttttaggtggaaaagttaataaagtgatgcacggagttgaaatttcaaaaatagtagggattcctcctgcgtcagcagaagtacaccagggtttatgcaaaagtggttattataataaacagtttacttgcccccatactattagaaagacctttgtagggcctcaagtgaaaaagggatcggaagttcatcaatttattaatgtaaacaaaacaacattttggaagtatactggcggcgcaattgctacttgggcagggaaaaaaccaactgttagaacgatatcctggactgaaggattatacctaacgaatatgaagggaatgtttttcccctccaattacacagataagcaatcaggattaaatatattagctccacctaatgcatttattaaatgggtgcctagcgataaaagagtaaaatggggaactacagaacgcaaagcatataggaaatggtatgataaaaaatacggcaaaaaaacttgggtgaaatttgagattcatcatcaactacctagagagtacggtggaggaaatcagacaagcaatttaattcctatcgatgtgaattttcacaggaaagaagtaaatccatggtgggcttcttatacaaaaaagaagtaaaattgtagatgaacgtagatgaagactcctatgcggagtctttttattctgaaaccagtttataatactctcggatattcggattcacttcccaatatttcgttccattggaagaaactaacatatcaaaccatatttcaaaattcgaatctaagttaatcgcatcttcaatatcatcaattgagtctagatatagcatataacctaatccattttttgatttgtttgtgtctatgacatatcttccatcaaaatgatatccaattaaaacgtatccctctgggaaatcttgaacctcattatattcaatgattccctctaagctaagtatttcaatcccatcaaacatttccatcccattgtgctgtaacaaaaactctttatagtcattagggaaggtaacacctagcttctgttctatatcgctaatttcttgaggactagcaggatctttgaaatgaaaagtagcatcttccatgacataccctccatgatgaaacatagggaatgttccgtatttagaaacagcttcctttattccattaagagtcatttgaattaacttcccttcttccatataactttccctcctctaaggtttagaccactaaattttaccacacaactttatttgagtgttttaaaatgacaaaatcaaatttacaatctttggttttatatttataattaggaaggtttgtccgatatagagacagaacaaacaaatttgggggaattacattgaagaaatggttgttaggtattggcgcattatctctaagcttttctttggctgcatgtgggtctgattctgcttctacagataaaacagattcagataaggctaaaacaacgcaacaagaagaaaaggatacaaaagagacaaagacagactctcaatcaaacgacaaaagcaataatgacaagaatgaaaaagccgaaaatgcttcaaagaaggattcgtcggataaaaagacatctgacaataagaaaaagctagtcgatgtaacacttaacagaacggttgatggagacacgattaaagttaactataaaggcgaagtcaaaacagttcgttatttgcttgttgacactcctgaaactaagaaaccaaactcttgcgtacaaccatatggtgaggatgcttcagcaagaaataaacagctagttaacgagggcaagcttcaactggagtttgataaaggagatcgcacagataagtatggcagaatgttggcttacgtttacgcagatggcaaatcagtacaagaaacactgcttaaagaaggattagcacgagtagcttatgtatatgagccaaacacgaagtatttagacacgtataagaaagatgagcaagctgcgaaagataaagacttgaagatttggagtaagaatggatatgcgactgataaaggatttaatggctgcgcaacgaaaccgaagaaatcagtaagtgtatctaagccggttcaaaagtcagttacaacacaccaatccgagacacataaatcgaaccctagcaattcaaattcaagcagttcagcatcaagcagctcttctaactctgcacaagcctccccttctgctggaggaacagaacactttgcaaactgcacagagctgagaaagaaatacccgcatggcgtaccaagcactcaccctgcttatacatctaagatggatcgcgataatgacaactttgcatgtgagaagaattaatccatcggaagccctctgaggcttctttttttatttgggtatattctatctaaataaaaaccacagagctctgtgagggactctgtggtctatagtggctgttaaacccctatgatacatcaattaggatactttaaattagattaataagcaagctgatctaaaatgtttcgttaaaatgaggattttataaagaaattccaatgcacatgatataatctaactacacttacaataagaagaaaggatgaaatacttggcgttacacgaaaattcaagaatagcagtttattcaagaaaatccagagaagacagagattcagaagatacactcgccaaacatagaaatgagctagaatatctcataaaaagagagaactttaaaaatgttcagtggtttgaagaagttgtttcaggtgagactattgatgagcgaccaatgttctcattattattgccaagaatcgaaaatggtgagtttgatgcagtttgtgctgtagcaatggacaggctctctagggggtcacaaattgattcaggacgtatacttgaagcatttaagcagagtggaacattgtttattacaccaaaaaaaacctatgatttatcaattgaaggcgacgaaatgctttctgagtttgaatcaataattgctcgaagtgaatatagagcaataaaacgaagaacgattaacggaaagaaaaatgccacaagagaaggcagactgcattcagggtctgttccatacggttataagtgggacaagaatctcaaagctgcagtagttgttgaggaaaagaaaaaaatatatagaatgatgattaaatggttcttagaagaggaatattcttgcacagtaattgctgagatgttaaacgaactgaaagtcccttccccatccggccgttccatttggtacggagaagttgtttcagaaattctgtccaacgattttcataggggttatgtatggtttggtaaatacaagaaaagcaaaagcaacaacagtattgttcaaaataaaaatctagatgaagtattaattgcaaaaggtcatcatgaaaccatgaaaaccgatgaagaacatgccctaatcctgaatagaatagaaaaacttagaacatataaagtggctggaagacgtttaaatatgaatacccacaggctttctggtattgttagatgtccttattgtcataaagcacaagctatagaacaacccaaaggcagaagaaaacacgttagaaagtgtttacgaaaatctgctgaaagaacaaaagaatgcgaagaaacaaaaggaattcatgaagaagtattgttccagtcaattatgaaggaaataaaaaaatacaatgaagctctcttctcccctactgagcaagatgttaatgatgactcttatacaactcagcttattggtttaagagaaaaagctgttaaaaaggcaaagggaagaatagaacgcataaaggaaatgtacttagatggggacatcagtaaaacagagtacaaagaaaagctgaaaatttcacaagagacacttcaaaaagctgaaaatgatttagcagaattaattgcatctactgagtttcaaaatgctcttagcgctgagacaaaaaaagaaaaatggagtcatcataaagtgcaggagatgattgagtctactgaggggatgtctaactctgaaataaacttaatactaaagatgctcattagtcatgtaacgtatacggtcgaggatttgggagatggtacgaagaatttgaatatcaaggtctactataactaggtttatgtcgtactcaatcaataattcttacgacagatccggttacgacaggcggaaaaaaggatacgagcttgccgaagaaaaatgacagcagaatgacaagcagacccgatgccaaaatgcttccgtaaatggctgaaatcccgtactccttaccgatggaaataatcggcgctaccgcggtgaacgtacagccgagcacaacaggcaagccgatgccgaaacatttattcctccatacttgaagcagcgtagccgccccgcacataaaaatgtcaattgatacgagatatgtcagctgttctgcgttcagtcccagtgccgctcctacaattaaaggaacgacgacggcgccggcatacatggcaagcacatgctggataccgagggaaagtgttttggcatagccgtttttcatgaacggacctcctgtacaaatgtcacttttccgtcttcaagcgattgaattctcgccagtgattcgacccggaatcctttttttaccagctcgtctcttcccggctgaaatgacttttcaatgacgattccgatcccgcaaaccgctgcgcctgcttgttttacgatggacaaaagcccctctgccgcctgtccgttcgctaaaaagtcgtcaatgattaacacgcggtcttctttcgagagatgatttccggagattgcaatctgactttctgtttttttcgtgaaagaatagacggacgccgtcagcagatcatccgttaacgtgagagacttcctttttctcgcaaagatgacgggaacgccgagttcaaggccggccattaccgcaggggcaatgcccgaagattcaattgtgacgattttggttatctcgtctttttcaaaacgccgcgcaaattcccggccgatctgctgcatgagaaccggatcaatttgatggtttaaaaaagaatccactttcagcacttgatcagaaagaacgattccgtcttctgctatttttcgttttaatgcttccacaatgattacccccgcttataaaaaataaaaaaagcattgcccgctctccaaaaaaagagcaagcaatgccgaatgatctacacgtaacggccgaataaagccgttccattgctcactcatagtcggacatttacggtgaccggtagaaacttgcgtgccatatccacgcgattatatgagtgttcgtatgatattaatcaaattataacaagatacacttcttttgcatagtgaaatttgaatatttccgaacttttacaaagaattagttttcgattattcgtctttttagaatttttagaaaaacacccggtgtatgccgggcgtttcgtttataaatataaatttgaatatttgccgacgagatactcaatgagatattgaacgtttaattcttctcccgttgcatcttttatgatgtcaagcggcattttgcgtcttccgtgctgatgaaccttttctgtcagccattgtttgatcggctcaaagtcgccccgttctattaattgatcaaattcaggcagatcctcaagcatggtatgcttcagctgtgccgcatacatatatccgagcgcataggaagggaaatagccgaaatcgccgcccgcccaatgtacgtcctgcaaaatgccttttgcgtcagatggcggcgtaatgcctaaataatcatgatatttttgattccacaatgcaggcagttcttccactgtcacttcattgctgaaaatcgctttttcaatttcataacggataataatatgaagcggatatgtcagctcatcggcttcaattcggataaaggtcggtttcgcctcatttacggcgcgtacaaagtcctctcttttcacatcttgaaattgatcaggcgaagcctcaaccattttttcataataggcggtccagaaatgttgatttctggcgataaagttttcataaaataacgattgggattcatgaattcccatggatgcaccgtcagataagttcgttccgctcagcgcttcgtcaatattctgctcgtagatcgcatgcccgcattcatgaatcgttccgaaaatcgccgtgcggaaatcgttttcgtcatatctggtcgtcacccgcacatcgccgcggttgattgtcgtcgcaaacggatgcaccgtctcgtccaggcggccgccgtcaaaatcatacccgaactcttttaagaaatacaaggagaggtctctttgttgttctttcggaaacgttttcgttataaaggaagtgtccggtttattgccggattccgtcacttttttgataagcggaatgatcgcttccttcaattcagaaaacagctgatccagcacctttaccgtaacacccggttcgaaaatatcgagcaatgcgttgtatggatgatcttcatagccccagtaagaaataaaccgcttattaaaatcaatcagcttctcaaggtacggagcaaacatagagaaatcagaggccgcctttgcatcctcccaagccgtttccgctttcgatgttaaaatgacatattctttatactcatcttcaggaatttttttattatgatcataatcttttttcgcaagttccgccgctttcactgtatcttcagagagctcttctgcatgcacgagaaggatgtcgatcagctctttcatccggtcggatgtctggatttgaaaaacgtcagccgacagctgtccgatgctttccgcccggtcatcagagccttttttcggggctcccgttcttaagtcccaatgcatgagcgcaatagcttcttcatagtgggatactctttttaacagattaaaaaactctttttcatatgtatgtacatccatatccgttcccctcccttttcactatcaattacaggctaatggaacgccgttataaagtcaacttcccggattaaaaaaagccgcaggataagattcctgcagctcttgtttttatacgattttcggtgtaacaggcaagacctttttgacttcggccaggacccgttcactttctccgcccgcataaatggatatggttccgctgtcctgattagaacggatgaggcggccgattccctgccggactctcaaaagcatgtacggcagatcaacttcctcaaacggatcttttttcgctccgttccgctttgcggtaaacacaggatcatgaggcggatacggcaatgcccaaatggtcacattccggagcgagtcaccgggaatgtcaagaccttcccataagtggacggaacaaagcacggattcttcatcccgctggaatttttcgaccagactgctgatctcttcgtcaccttcgtagtaaatcggatacggcagctcccacgcggcagcctgttctttaaattccttcatgtcttcaaaggaagggaaaagaacgagggtgcgtccttcattctccttaatggtttcaatcgtttcgactgttttctgctcagacgtcatgtcaccgtgaagcgcaacagacatttgctcctcgtaatcgtacggagattcaacggtaaatgataaaggatcacggattccgagactgtcagcgatataatcaaatgaaccgccctcagaaagagtggccgatgagaagatataaggtatctttttagaaaagaccttttctcccaaaacttcggctacagttctcggcataacgacaaacgttgagtctgtatcccgcgtttcaagccagctgatggcatccttttgatacagcgacagcgaatatgccatttgttcgacgtattcttctacaactgacagctcgtacttatcaatcgtatacatttccgattcaaatacgagcgcctcgccgattttatcgagcagacggcacagttcgtcagccgcacgcttaacacgctggtcgttttggatgtccaatcggtgagagccggcgatttccttcgattcctctgacagcacatagaaaaactcatcgtttgcggcaagggcatcttcaatcagttcggcgaattcctctctgatgtcattttgaagcagacgctctaaaaacagctcaagcgtcgactgcttcacacgatacgttaacgctttttgcgcggcgaattccagcagatgtccttcatcaaacacgacggcgctgtgatccggcaaaagcggcagctgcccttcccttttgcgtgattcttccgtccatacatgctccatgtagaaatcatgggagcaaacaatcagatccgttgattttctgtaatgatctcttgaaagtgttaaaccgcatctatgtctcatatcacatgttaaacaatcttggaaggaatcatagctgacgcctgcccactcttcatttgtcaaatcagcgtactgtttgcggtcgccgtacggataaaagcgctgcatcgcttgtgattcgtgtacgaatgaaggcagcgactcataaagatccagccacttttcatcatcagaacgctgcatcgttttctccagctttttcagacagagatactgctcatgggatttggacagccgtgtatcaatctgcagatccaaatgttctgtcagcttggaaatgtcgccttcttttttgacaagctgttcaattaacgtttcatcggcgcatgcgataatggccggtttacccgtatatcttgcatagctgatggcaaacagcagatacaccagcgttttccccgtaccgactcctgcctcagcgaacatgacctttttctctttaaatgcccgttcaagctgaaacgccataaatacctgctcatcccgaaggtcaaagcctttctcgggaaggatatcgtaaaacacgtcaccaatccaattgttcaattcttcgtaaaaattcttttcttttgttaaagcaaaaggcaaacgtgatgttgtcacccaactccaacccctaactattcggcattcagaccatctataatatcatttaacccttttcaatacaacaaaaaaacttggcctcgccaagtttttgtcattatcatttccggttaatgatatgtgtacataggaacggatggtctgttgaatgtgtatgttttaccgcattttcaagttcttcctgtgcgtgtgtcatgacggaaggaccgaacttagctccggcttcctccagccggaaagcagttgcgtctaacgccttttgtattttactgaagtgctcgctgttcagcataaaataagatcacctctcaaatagaaataatcatcattctatgccgatgcttcactttctatacatgccatcctgaatgatccgcacctgacctgcacaaactacaacagatattcgatcgaatatccatcttcacaaaattattctatccgggagtgatggttacatgagttataaagatcgattagatcagcattctgaattgtttcatcacaattggacgcggccgaaacgctctaaatcgcaggtgaacggccacaccgaaatgtcccagaccaacattattttacggagcaacgcaaaagcgcaccgctggtaatggcagaataaaacgtaaagatgccggagaagacgctgtatcaggcgtcttctctttgttgcggctttttccgctgcggccgcactttagcccagtactgataataatccgttttgataaaaccgttaaagagcttccgtttttttgttgcttttcttccgtagacctcttcaaattgttcatttgacgttaacatgtagacagaccatgtatcaagagattcaaatgcccggcccatttctttatacatctgctcgacttgctttttttcgccgagccgttcgccgtacggagggtttccgacgataacgccgaattcgagtttcgtcgtaaaatcctgcactcgcatctgcttgcattcgatcaggtccccaagtcccgcttcttctgcgttttctttggcgatgtttaccatccggtgatccacgtcactggcaaaaatctgcagcggctgatcatagttcgccttttcttccacttcaaggcgcgccttgtcccacagttcttttccgatccattcccagtcttctgaagcaaaatcacggttaaaacccggagcaatgttttgcccgattaaagcggcttcgatggcgatcgtgccggaaccgcagaacggatcgacgaacggacggtcaggcgtccagttggttaacagaattaacgcggcagcgagcgtctctttaatcggagctccgccctgatcaaccctgtatccccgtttgtgaaggcctgttcctgatgaatccagtgtaagtacggctttatcttttaaaagggaaatctccaccttatactcgggtcccgtttcttcaatccattcattttgttttcctgattgaagtttcagctttcccgctatcgcctttttgacgatccgctggcagtcaggcacactggcaagcactgatttcacggactttccgataacggggaactttgcgttttctggaatgtacgcgcgccagtcaatcgcttttgttttttcaaacagctcatcaaacgtttttgcctgaaactcggcgacctgtactttgatgcggtcagccgtccgcagccataagttagcgcggcagatcgcaagcgcatctccttcaaaaatgacttttccgttgtctactttgcattcataacctaaatcacgcacttctttggcgacgatcgcttcaattcccatcggcgccgtcgctattagtgtgtacttcttcatcgtatcaccctgtctcttttaagctttcgtttcattcaagataaaagctcccctttaaaggagagctctaatttgtcatatcaataatgtttaacgttctgtaagccatgttttgttccgtcgtactgcaatcggctcatcacctcgtactcaggcggcaatcatctatctacagaaagtattctgtccttctatctgttcagttccttcaagaaggttcccctaccaaaatttgggtttctcgctcgaggggtttaccgcgttccactctcaacatttctgatgagacttcgtcactgtggcactttcaaggatactcagccatatccggagacgtaggcttttttcctgccgtcagcctatcaaggctgccctagcttatttcttcgctaggcacgaacactacgggcatctcagcaccgtgcgagcatggactttcctctacagattcaaagacctgcagcgattacccgaacgttaagaacacttgttcattataaagcaacttgtctcatttgacaagtgcatctgccttattcgtcataaagtttgctgccgaatacatgtttctcaaggttggacagccttttcagaatatcaaagttggtcgtattggactgcaccggctgttttttgctagcttcttcaagctgttttttcagctgcagattttcctgctgcagttcttcaatttcttgatgaaaggtttcataatccttaataatcatatctaaaaatttgtcaacgtcttcttgtctgtaacctctaacgcctgttttaaattctttttccaaaatgtctttcgcagaaagctttactttatcagcaagcatctttttcacctcatatcgtgaatcatcatgttatattttattcagaaacacgtcccgttgtcaaatattctctgacgtgttatgtaaagaaatcttcttcctcaacggcggcacggagatcatccatcgtaatcgaataaatcggatatccgtctgtttcacggcgtttttctgcctgctgcagcatatatttcggcgatccttccacctccggatcatataaaagcaaaagcgcatctgacttttcaataaagaacgcgtttttctgccggaattggagcggactttcgtacggccgatgcgtcaggctctcctcataatctgcctgagcaagcaccgcttcatacatttctttattcggctccttccacttttcctcctggccgtagaaaggcgtgataacggcaacctttaattccggatactcttctctgagatcgtacgccgtttctgccgcccaaagctcagtccccagctgtccggatatgagaatccattccaagccttcgtcaataaagcttctgagtctggtttctatcgccttttttatataaacaagcgcccggtcatcctgtttaaagataccgagctcaaacggcttgtaccccgttacggctaatactttcaattaatcacctgcttaaaaaatggggctccccatcgggccccattttgatttgctgatatcctaaccgatcttgcttaagcgttcaatactaatgatcgcagcaagggcttccgcactgaaaatgctggtgagttgtcgggtcaacatttgaaaaagtgtgcggatagtaatgaacgtgctcaaagttgtggtgatttacgttagttgtatgttgcggatgaatatgcggcacaaccgtgttagaaaagcaatggtgttcacagcaatgagtcggatggacaatcggcggcatcacgtttggtctgcaacaatgatgatgaaacatgctaaatcccctctccattaacttttattacactgttaggttatgaagaaaagagggtgcatgttctaattcaatcacccaatttaaaagtgtgtcagcaaactgtctttaaaattcgaaaatacaaacgcaatcaaaaaaaccacgacaaagaacaagtaaaaaacacctttatacataccaactctcccctataaataactaacgctattttacaagatgcggcaccattctacaacaaaatcgatgcggattcagaaaaaaatatttttggcgaaacagctcggcttttgcgctttcccgggcaatatttcaagaggaatatttcctcttgagccgggcaattctcacatggagcttctcggcttctttttccgatatttccccgtcttctgccgcctgctgcgcggcctgcagagcttttttgtaatcttttgcatggtgctcaaaatagatcgccagctcaaccgctgattggtgtctgcatgtgtgaagatcagagtccgtcagtttctcccaaaggggcacggcgtcttgcctgcggttttgttttttataaagcatcgctaagtcaaaaagggcccgatccgaatcttcaaagtctttgccttgcagcgcttccagctgcaaaacggcgcgatcggtttctttatgagcgataaaccatttcgccatggcgtatgcttcctgacgttctgacgtctgatcagaagatgcaaaaatcttttttgacatatggatgtaaagagcgatgagggaaagcacatcttgttcattatgcgagagcactccctttaaaagagccgggtcctccgcctttaaaaattgaaaatacagcatcggcgccaaataaccaggggtgtcttcgtcccttttaaaagcaagctcttcattttcaaccgccgaaagcgatacacgctctaatttatgtttccaaagccgtctcgccccgtgcagaagatcaaagtgcccgaagtcaggaagtttcggaagcctgtcccgcagcaatgtatgcctggtttttacctgcggccagtcaaaggcttttccgttatacgtaacaagggacgtaatgtcaacctcacttaaaaagcttttgtaaagagctgtctcgtttcccggtttagggagcagatgctgtttaaccgcgacacggtcttcatacactcttgcatggccgagcaaaaagatcatattgcctgccccgccgccgaggccggtcgtttcagtatcaaagaagaacagctggcttttttcgtatccttctgctgataaagtatgtgtcaaaccgcctttattccataatgccatgacgtcatcaagttcactgaagctgtaccgtccgtggcggtgcgaaagcggatagacggtttcgcggataagacagtattcatcctcaaaaaagaaaggcttcactccgaatgcctcccattcttctctaaacgggacttgaatatccgggaccgaaagttgtgaagctgccggctttttttcagcttccggcacattcaggtggtttttcatccgctttaatttatttttcaaggacatctttcgtcccccttttcttttacacgtaattcaagagccggagtatcgctttctttgcatctattccttctatttcggagccgatgcaggaaggacacccgtcttgacatggacattgtcggatcaggcgctcagccccttcattgatttcatcaaatcgtttatatacttcatcggcaagtccgattccgcccggataatgatcatacagaaagattgtcggaagtcccgtatgtgcggctttgatttgcggcacgacatgcacgtcatttcgatcgcacatgacgtatacaggcacgatatgctgcaggacgtgggcaatgcctaaaagcagctgttcaagcgttttttcgccgatttccgaatccgtttcttttaattcaagccagactgcactggtatgcagttcttcttcaggaagatgaatcggtcctgatcctatattttcaaatgtcgtcattttaatttttttaaatattgtcggaagtgcgttcacggtgacgtcgccgaaatgtaaggccgttttctttctgctgtccgttctgtcaatgtccagcactttcagctgcaccgctaaattggcatctgtataatattcgacatcgacctttcgcacgtacgcttttttatgttcccaatcaagcttttcaacctgatactgcaccccttcatgaagataaatcgcttcatcatgaagaagcgtcatcgcgctgaagcggtccatttctccgatgatttttacatcagccgtctctgaccggtcaacgatgaccacgttttcctgtgacgccgaacggagactgatattggaggcgggaaaagattcgctcgcccagtgatagcgttcgcggttttcgtgaagcaccccttcttcctctaaatactcgagaatgtccctcgcatcattttctccgaatgtttcatcggctctgaaaggcagctcatatgcggcgcatttcaggtggtcgaccaatataatgagattatcgggattaatccttgcagattcaggcgagcgtttaaagaaataatcaggatggcgcacaatatattggtcaatcggatcagagttcgccaccatcacgataagcgcctctccctgccgccgtccggcccggcccgcctgctgccatgcgctcgcgacactgcccgggtaccccgtcatcacgcagacctgaagctggccgatatcaacgccgagctccagtgcgtttgtgctgacaacgccgagaatgctgccgtctcttaacccccgctctatttctcttctttctttcggtagatatccgccgcgatagcctctgacagacttcgcgccgatttctttttttacgatctcctgaatgtggcttaaaataatttcgacccggacacggcttctggcaaaaacaatcgtctggatcttattttttaaaaaagttttggcaagttcgttcacttccacggtggcgctttttcgaatatgcagcggtttatttacaatcggaggattgtaaaaagcaaagtgctttcttcctgccggggcaccgttgtcgtcaatcaggcgcacagattttcccgtcagctgctccgccaactccctcggattggcgattgtggcggatgtacagataaatgacggcttgcttccgtaaaaagcgcagattctcattaaacggcggatgacgttcgccacatggctgccgaatacaccgcggtacgtatgtaattcatcaatgacgatatatttcaggttttcaaacagactcacccattttgtatgatggggaagaatggctgaatgaagcatatcgggatttgtgatcacaatatgcccggcctttctgactttctgcctgatagccggagacgtatctccgtcataggtgaagcttttaatatccatgcccgtctcgtctatgatttcattcagctcgcttttttgatcctgcgcgagcgcctttgtcggaaataaataaagtgcgcggcttgtggcatcttccgcgatagactgaagaaccggaagattatagcacagtgtttttccggaggccgtcggtgtgacggccacaatgctttctccgttttgaaccgtctgaaaagcggagtattgatgtgtaaaaagccgctcgatccccctcttttcgagagccgcccgaatgttcggatctacttgctccggcatcggcatcgttttcgcctcccgcggttcctcttcatgccaatgcacaatattttcatgattttttaattcctgaatcagttcgctcagtgattttttcttcatcgttcacacctctttatgaggtacagtttaccgaatatttgtttgcctggctagatgaaaatcctgcacaagaaaaaaagcagggaatcagcccctgcctacttcatttttatcgtaaaaagctctgtttgtccttttttcgcttcatttgcgcctgcaaattgcaaaggttctgcggcatcgccattcataatcaccatagggatgacggtgctgcttgctttttcttttattaaatccagccggcacgttaaaagcagatcgcctgttttcactttgtctccttcttttacatgcgcttcaaagccttcgccgttcatattgacggtatccaaaccgacatgtatcaaaagttccgctccggaaagggtgcggatgccgacagcgtgttttgtatggaacagctgaatcacttctccctcaaccggtgaaacaatttctccgtttgcaggctcgacggcgatcccgtcccccatcattttttgtgaaaatacaggatccggcactgaagccaaatccatcaccgctccgtcagccggagaaaaaatcacttcctcggccggctttttccggctgtctcccaatccgaataattttttcagcaatgtgttgtgctccccttcctaaatgtgaatccgttaccagtttattctccactatttaaccatactttcttttttccttcaattcttaaccatacggcatagcatcgcatagtctgtttgtaaaaaggcggtggtcatatggatcaatcccaaaacgataaacttgatccgcaaagtaatgaggacatcatcagccatgcgatggaccaattttttcactcaggtcccttcgcagaattgatgcagggttttcagcaccttgtcaattcggcttttactgaagcgcaagtgacgattgacgtcagagaagagccgacggggctcgcggttgatatcggcgttcccgagacgttccgtgacggggatatgctggtggaaacgaaagggtgctaccttcacgttacaatccgctacgatcataaacaggctcaatcatcccatgtgtcttcaagcatgacaagaaccgttgtcctcccgtataaggtaagtgaagaagatatggaaacatcctggaatgaacagacgcttaccttctttttccctaaaaaataagcatgaatgatggatatcattcatgctttttatttgaagatactggtgaagcctttcaccagcgatccgacctgatttacggcgcttaccatctgccccgttgtatccatcattttattaaagtcaaactgtccgttcgtttttttaaactgggagagtatgcctgagaattgggaagactgctgctgattcggtctgggaacggggtaaggattcacaaaccccggctggcccccgggcatgcctgcctgaggaggagcaggagcaaacggctgctgtatatgaccgtattcctgattcggataaaattgctgcgggtactgcccttgctgatgatatggcggctgttgcaatggctgtatctgctgcggatacggcggctgtaatggctgtatctgctgcgggtagaaatatcccgccggctgctggtacatattttgatatggctgcgctctccattgcatatgacattccccccttgtctctcactaagtttctgctatatatgtatgaattccgccttggttatgtgctttcggtgattctgctctttgtcaaatgctgtcgaaagtcttaattttttaaaaacagaaaaaagtcgaatcgttatgttaacataatctcaacatacatgagaggggatgcaccattatgaacgtatcatacttaagaaagcgttttgctgaagtgaaaaaatatgaaacagattgtgcagataaactgatggactttgcaaaattcctctatattcaaggccatctcaccgcaaccgaatttcgaaacagtatgaaggttctcgaagcaagtggagcagaaaacccggcgtatgaataacatacccgacccctttatataaaagaaggcagccgttttcagctgccttctttttcaatttcatcccttaatatacgaagcgtatataaaacagattcagttaaatccctgtatctttttttatgaatatgatgaacatatgattggagcatcagctccccgaaattttctgtaacggcctgaatttgtgcatgatgaacgtatttcggacggttttcctgaataaacgcaagcgctgcttctgtccaaagcgcgcaaagccggtctcttttttcaacatcgggtttaatcgtctcaaaaaaatcatatgaacggcctgactcttttccatcctgataccttttttcggcttccagaaccgcctctatcatttgttctgtcagctccaataacgactgtgtctgcaaacggactcacctcagtacatatggtaccaaagtttttgcacaaaatcagcttatccggcagactcgcggcaaatcctttttacgccggtcagtcaaaaacaggtcatcaatacaaacatgaagctcccgcgcctcttcctcaagacgggaaagtttctcctgtctgatttcttcagcttccgcctgacagcatctgactgcttgggtaagcgttttttcagcagcagaaatccggatttcgatatcagaaagcagacggagaatatcagccttgctcgtgtaaacagacattcatgttcctcccttttatcacttgcatctctttcaaatataattctcgttttcataccgctctcctctgcacatgacaaaactagaagcagttcggcaaacaaacagagattatcctaaaaggcgtgcctttcgacaaaaaagtgccgcaaactttgtatgaaccggcacgttaatgcaaacgatacagttgaggaggtgccgtatgaaaacgagaccgaaaaatgcaggtaaacagcaaaaaaccgaagcaaaaacgactgatacgcttgataaaaaattaggcggcccaaaccgcccttccacgtaacacatcagcagcccgaaaccccagcgaacggtttcgggctttttcatttcttcagccactctttaaccgcgaagagcgcatggagctcccgtcttttctggaagtaccagtccgtcagttcaagctgtttcggcattttctcctgtaagaaagccccttttcttaaccttttttgaaaccaatccgccctttcgccgtctaatgggtgggcaacaatgggataggttgtcctaagcatcggtgatgttctttttttgatgccgatcattttctccatatcaaagcgtgaaccggtatgaggaacggtatcaagaaaacggtaaaaagaagcgtgaagatcagggctgaacagaaggcgggccagctgttttccgagcgtaattctctcttcggtttttgaaaaccgtttgacggaaattccgtataaatgtccgtcaaatgaagggaatatcaccgtattaaagtgaaaccaatcacttaaataaaaaggaatcgtgccaaaaacattctttttaaacgaaggattttgtataataggtgcttggatagtgttttgttcatttataataagagcatacatgagccgttccgtatctccgtcacgccaaaagcggaaccattcttcctgcataaaagccgagacgcggaaataaggaagatgacggaaaagaggttcgccgatttgttttgaccactggtagaccagaagctgaggataggcatcagaaaaaatcagccaattcgccctttcatacgaaaggaaaaaccagtttttctgactgctgtcaaggccctcctgataaaggacgcctcttaaatcagtcatcgaccagcccgcattgcgggacacaaaggatgccaaaagcggccacttgatctcaggatggcggtcataatatgctttataggcattcgtccgggaaatattatcggcattttttattttcgtctctttttcgatcaggcgaagaatggcggttacggtctgtcgtttatgcacgttcattcacttccgtcactattagtttgataaggaggatggaaaaagtgattcggtacccgaatggaaaaacttttcagccgaacaaaacggtttcatcccaaaacagccagaaacggtctcattcatacagtaatcgcggcatgaccctcgaagacgacctgaatgaaacgaataagtattatctggctaaccaaattgctgtcattcacaaaaagccgacacccgtccagattgtaaacgtccactatccgaaaagaagcgccgcagtcattaaggaagcttattttaaacagtcttcaacaactgactacaacggcatttataaaggacgctacatcgatttcgaggcaaaagaaacaaaaaacaaaacggcatttcccctgcagaattttcatgatcatcagattgagcatatgaagcaggtggtcaggcaagacggcatttgttttgttattatatccgctttcggaaaggtttatttcctcgaagccgacaagctgtttgtcttttgggagagaaaggagaagaacggcagaaaatcaattcgcaaagacgaattagaagatgcttcctttccgatttcccttggatactcaccgagaattgattatattagtattattgaacagctttatttttcgcaggaacagtagactgagcgaaaggttgataaacgaaaggttgagatgttatgtcagatcaatttacgagccgtgaagaacgccgtaaggcaaggcagacgaaaagcactaagccctcttcaccgaaaaaaggcaagaaacagcgtaaaggcggtttattcaaaaagattgtgctgtccttggttattctgtttgtccttggcatagtcggcggagcggcggcatttgccgttttggtttccggcgcgccgtctttggacgaagccaagctgaaaacgccttactcttcaacgatttacgataaaaacggaaaagaaatcgcggaagtgggcggtgaaaaacgaacctacgtcccgattaaggatatacccgatgttgtgaaagaagcatttatcgcaactgaagacgcccgtttttataagcaccacggtatagacccgattcgtatcggaggcgctttggtcgccaactttacggatgggttcggttcagagggaggaagcacaatcacccagcaggttgtgaaaaactcgcttttgacccatcagaaaacgattaaacggaaagcacaggaagtgtggctttccctgcagctggagcgccattattctaaagatgaaatcttagaaatgtatttaaacagaatttatttctcaccgcgcgcctacggcgtcggaaaagcggctgaagaattcttcggcgtaaaagacttgagcaagcttacggttgaacaggcggcaacgcttgccggaatgccgcaaagcccgaccggatataacccggttaaaaacccgaaggcttccgaaaaacgacgaaacatcgttctcagcttaatggaaaaacaaggattcatttcaaactctgaataccaaaaagcgaagaaagtgtccatgaaagatgaaggcgtcgtcagccaaaaggaatacgataaaaaggacacaaataaatacagcgcttttgtcgaagaagttatgaaagaaattgagacaaaagaaaagaaagacgtcgatatttcaactgacggactgaaaatttacacgactcttgatacgaaagcacaagattatcttgatcaattgatgaacggcgatacagccggatttaccgaaggcatgcagggcggcgtcacgctccttgatacgacaaacggagaaatccgcgccatcggggcaggacggaacagaactaccgggggattcaattatgcaacacaaggtaaaacccagcccggttcgacgataaaaccgattcttgattacggaccggtcattgaaaataaaaaatggtcgacgtatgaacagattgacgactcagcttatacgtactctgacggcacaccgattcatgattgggacaataaatacagaggccagatatcaatgcgagaggccctcgcagactcacgtaatattcctgctttaaaagcataccaagcagcaggaaaagatcatgccgtcgacttcgcaaacgacttaggattgggattaaacaaagatcaagtatatgaaccctactctatcgggggatttggtgagggtaaccgcggtgtatctactatgaccatggcaggcgcctacagtgcgttcggaaataacggaacgtacaacgaaccgcacgcggtcacatcgattgaatttaatgacggcactaagcttgatttaacaccgaaaccgaaaagtgctatgagcgactacacagcgtttatgattacagatatgctcaaatcagctgtcgaatcaggaacaggtaaactggctcaggtggcgaacgtggaagtcgccggtaaaacgggtacgaccaactttactaaagaggacattcaaaaatataacattgctccaggcggagtcccagactcatggtttgtcggatacacccctcaatatacagcggcggtttggaccggagttgagtctggcaacaaagcaggcaagaaatcactgtcttctgcagaccagcaagtcgcaaaacggattttccaaaagctgatctcatacgttgatgacggtaaaggaagcttcaagcagcctgacagcgttgtaaaagaaacagttgagaaaggctcgaatcctgccgctttagccggaccgaatacgccggatgataaaaaagtgacggagtacttcgtgaaaggaacgcagccaactgccgtttctaaaacgtacacgaaagaaaaagccgataaaccgacaggattgcaagtgaaatacgacaaagataaaaaatcattaaccttaagctgggattatgacggtgatgcaacattcaatgtcaaacaatccgttgacggcggaagctacagtgacattcaaaacagttcggcaaaagaagccgtcgtctcaaatgtcacgccaggctccacatacagcttccaggtgacagcggaaaacgatgacggaaaaagcgatacggcatcagcatctttcaaagtcccgaaagatgaagaagacgatgcggataaagataaagcgactgacgatgaacagaagactgatgaagataaagataaggacaagacgcaaaccgatgattcaaacaaagatgacgatcagacagatacgtctgacggatcggatcaaacaccaactgatgacccggataaaaatcaggatcaatccgataaggatcaaacagataacaacaatcagaatcagcccggcaacgggaccgataacaacggacagcaagataacggctctgataatgattccgattccggttcagacggctcaaataaacctgacagcggtcaaacggataaaaaccaagactcatcttcaactatcaacgggcagtccaattcgtcaaccatccagtcaaatcccgctcattagcggacgaaatccttcaccccaaacaggtgaaggatttttttcgtacaaaaaacctccttatgggaaaaggaggtttttaacatttgttcatggcttcatatttatgatattgtttcttcatctccgtcatcaattcatccagctgaataaacgagtgatattgagtcggttttgttaaaataaacgccattcgctccgcccaattgatcggttccgcgggaaaatgctttgtttcaagcacagtccagtcgagtgatgtgacccgctcccctgccgtccaatgaaaagcggcaatcagacaggctattcccttcagcatgtcattttgatcacacctcgattttcttgtttgaaaaacgggaagcagcgtttctttcgtttcattccaaatctgaaaaagaaacgggacatattcgcccctttccctccatggctgcactgttggctggccgctgaaatccatatacagcggatggcggcgcagcgccgctttgatctcgaggctttccaagtccgtaaggctgcgcaggtatgtttcatagcctgccagaatgtcaatcgccgtcaccgtttcaccagcccttttttgtcacgcttctgcccttctctgcatagcggaagcaaaggacattccgcacagcggggagattgcgctttacagtgataccggccgaaaaatattaatctgtgatgcgtaacagaccaatcctctttcggcacttttttcattaatgttttctctacttccaaaacagagtccttccagcggcagatgccgagccgtttagagacccgctccacatgagtgtctactgcgatcgcaggtacgccgaaagcaacagacacgaccacatttgccgttttccgtccgacacccggcagcttcacaagctcatcccggtctttcggcacttctccgccgtactcttcaatgatcattttgctcagcttttgaatatttttggctttattacggtacagaccgattgatttaatatcctgctggagttcttccagcgatacggcaagataatcttcaggccgtttatatttttgaaatagcgtttttgtcactctgttgacgagagcgtccgtacattgcgcggataatgcgactgccacaaccaattcgaaaggatttgaatggacaagttcacattctgcgtgcggaaacatatcgccgattttttcaagacaatattcaatctgctttaaatttaacacgtttctccccttctcatgttattgttccagccaattgtaaaaaggtacctgcctcgtatactctttttgcggatcattctgtttcgtttgaacacgccggaatttttggctgtgcgccttcgcctgctcaaccgttttgaagccattctttttccattcaaataaaatccggtcaatatagcgaaaactgagtttccccgataaaacggcttcttttaaggcgtgtttaatcagaatcgcatcatgctgatcctgatcctgccatatggccagcgtctcgcattcaagcggcgacagcggtcttccgaactcttcttcaaagatggtatacaggcttttttgttctctttctgacgttctttcctgcgtttcattttgagaatgctgcatgtaatcatacagcttcgcccataacggctgcagagaatatttttcaaactttatgccgttatggtcttcacattcttcaataaacagaaaacctttttgaataaacattctcaggcagcttgtacactcttcagcagagatggacatgcctgattgaagttcaaacggcgtcggaaaataagagcccttttccaaatgcattttaatcttcaaaagcaggatcaattcggtttcattcagcccgagctgccggtaatgtgtcagcagcaggttgggaatgcttgaaatgccgagttcctgcatatctataaattgctgttttttcatccttacacctcttactgtaaaaggttatctccgggagctttcccctttacttagaaaaagtctcccttgcaggagacttcgtttttcataactattacggatacagacggttcagaagtctcgggaacggaatcgtttcacgcacgtgaggcgctccgctgatccaagccactgtccgctcaagtccgagaccgaagccggagtgcggaacagaaccgtattgtctgagttcagcataccatttgtaagcatctgaatccagaccgtgttcttttaatctttcttccaataaatccatatcatgaacgcgttctgaaccgccgatgatttccccgtagccttccggagcgattaagtcggcacataacacgacatcgtcacgatctttggcaggctgcatatagaacggttttaatgacgtcgggtaatgagtgataaacaccggtttgtcatagctttctgcgatcgctgtttcatgcggcgcaccgaagtcatctccccactcaatatcgtcaaagcctttttctttcaggaattcaatcgctttatcgtacgtaatgcgcgggaatggcgctttgatttgttcaagcttcgatgtgtctcttcctaatgtgttcagctcgatcttacaatgttccagcacactttgtacgatgtatgcaacataattctcctgaacttcaaggttttcttcaaattcaacaaatgccatttcaggctcaatcatccagaattcgatgagatggcgtttcgttttcgatttttccgctctgaacgtcggtccgaaagagaatacttttccgagcgccattgcagctgcttccatatacagctggccgctttgagacaagaaggcgtcttcatcaaaatatttcgtcgcgaacagctcagtcgtgccttcgggagcgcttcccgtcaaaatcggcggatcaactttcacgaagccttctttgttgaaaaattcataagtcgcacggatgatttcgttacggattttcataatcgcgtgctggcgtttcgaacggagccataaatgtctgtgatccattaagaattccgtaccgtgctctttaggcgtaatcggataatcagtcgcttcgtgaatgacttcaatggatgtaacagcaagctcatagccaagcggtgaacgctcgtcctctttcacaattccttttacataaagtgacgtttcctgcgtcactgatttcgcaatttggaagatgtcttcttctacttcagctttgacgacaactccctgaatgaagccggtaccgtctctcagctgtaaaaatgcgattttaccgcttgagcgtttattagcgacccaagctccaatcgttacttcctcgcctgtgtgtttatacacttggttgattgttgttttcaaactctttccctccagaacaagaaagacattcaggaatctgcctgaatctcttttttcatcactttattatacccgttctactctaacggggtcaatgcaagtgaaaagcggctttaaaagccgctttttcagaatcagctgtgtttttccgtaaagcggcggattctcttgaccgcttcttctaaaagatcgagtgacgttgcgtaagataagcggacgttgtccggtgaaccgaaacccgagcccggcacgatggcgactttttcttcttccagaagcgccttgacgtattcatcgacatctttgaatccgcagttttctgcggccgctttggcgttagggaacaagtaaaacgccccttcaggtttgacacaggtgaatccgggaatctcactgagctgagcgtaaatggtattcagtctgtcctcaaatgcctgtctcatctcttcaagcggctcagccggcccgttataggccgcaatggcgccgtattgagcgatggacgtcggattggatgtgctgtggctcgcaaggctcgtcatcgctttaataatcgtctccgaacccgccgcatagccgatcctccagcccgtcatgctgtgagatttcgaaacgccgttaatgataatcgtctgctctttcaattcatctgaaagctgtgcgattgagacgtgtttttttcctccgtatgtaagcttctcataaatctcgtcagaaacgatcagaatgccatgctccagacacacttttccgagttccgcaagctcttccttcgtatacataacacctgtcgggttgctcggtgaattgataatgagggcttttgttttctcggtgatagcctgcttcagctgctccggtgaaattttaaactgattggattccagcccttctgcatagacgggacgcccccctgccagtttcacctgctcaggatagctgacccagtaaggagtcggtataatcacttcgtccccttcatcgagaatgacctgaaataatgtatacagagcgtgtttcgctccagtgcagacaatgatttctgacggcttatattcaatcccctgatcgtttttgaatttttttgcgatactgtctttcaaggccggcagaccgcctgaaggcgtatatttcgtatagccttcattcatggaacgcaccgcggcatctataatgtgctgaggcgtattaaaatccggttctcctgctccgaggccgatgacatcatggccttccgctttcagctctttcgcttttgcggtaattgcaagtgttgcagacggtgttaatgcggatactctttttgccaatttcaacttgaactccccctaatacgtctcacggtgtgatgtttttgagaatcttgccgcttgtaaagtccacatagctaaagctatactgcccgcttttgttgatataggtcacttcccataacggaacattgttttctctcgccgggtgaacgccattcagcttggaaacaagcccttcgtcccgaacgatcttggcagccttgccgcttgaaatgccgtcactggctttttttgagagaatttttgcttttttgtcggccggaacccatacatacatatcttttccatgtttatccgttccggtaacaacataatatttctgtttgccgacaaaggtctccactttctcagcgtctgtcagattcgttttttctttagcggctgcggcagctgtttcgtggccttcttctttttgagccattgcagatttaaaaatgctggccgaaaataaaagaactgctaaaaaaataataccaaatacggctgtaaatattaatgctttttttctcatctttttcacctatgtgcgataaatggtgaagaccgcttcattttgattttcttcgtcgagcgcaaggccgaacatcaggttgtcccgtttcaaagtccggtttaatgtatcgacgattttatataaatcatctgaatgctccacattaatcgttgacagaatttcaattttgctttccatttttataccctccatcggtcgaacaaattttgttagtcataacgggatgcgcccgcggcataataaaatcacaaggcggcatgaacccgcttttactataaaaacaattcctcatcccacaccacgaaagccgcgtttatgcggcttttattccgtttggctgacataagccccgagttcggcatccgtcagctccaaaagggatgaagtcgggagcgcttcaagaaacagccgtccgtatcccgccgtctttacacgctgatctaaaagaacgatcgttcccttgtctcccgccgtacggagcaggcgcccgatcccctgtctgaacgttaacacggcctcaggcagggaaatcgtctgaaacggatttttcccctgcttcttggcaaattcgcattttgcggcgtgaagcggattatcaggcgccctgaaaggaagtcttgcgatcatgacggttgacaattcatcccccggaaaatcaacgccttcccagaaatgattcgttccgagcaaaatcgaccggcttgccgttttaaaggttttcattaatttaccgggactcccgcctgaaataccttgggcgagaagctgaatgcctgagatctccatactgagtttcagttcctgatacacttttttcagcatatcatgagacgtaaacaggacaaggatcttcggctgttttccctttgacatgatttctgcatacttggcaatatgctcaatgacttcccgctccccgtcatatttaacggatttcatctctttcggaatgatgacgttcatctgatcatcgtaagaaaaaggagacgggatgcttttggtgcgcggataaaaatccgcaagtccgagcctttcaatcataaattgaaaagactgctccaccattaaggtcgctgatgtgagcacaacgctttttttgcgggcgaaaaactggtctgccagcatttcaccgggctccaaaggctgcgcatagatgctgacggcattttttgcgcccttcgcatcaatttcaacccaaacggcttctttctcatcattttcaaacagcagcctgctgaacgtatcgcgatattctttcagccccctgatacactttacatattcgcccgctaaaaaagccgctccgcttttcatctgatcaagcttttgatgtaacagtttctcctgtacggaaaacatgtcaagcagctgatcaagcatcgcacaaagccgctccgctccgtccgttatcatgtgaaaccctttatcctggcttttatgattgagactatagacgagacggttcagatcgtctttaggttttcttcgtttgacaaaagaatgcactgaactgaaaaatgcgtcgctttccgattgaatatgcttcatccactcatcggcgtcaaaaaaactttccgccggcagttcatacgtataaaacagttttctcatccgctttaacagtccgtgttcctttaaggtcccgattcggctgagctttgtgtgcagtccgatgtatgaagctctcttccccaggtgctcgctggcggcgcgttcgaaatgatgcgcttcatcaatgatgaccgttccgcttgcaggcagttttttcgtttcactgctttgatctgaaaacagcaaagcatggtttgtgataatcagatctgcggcctgcgctttttctttagcccgttcataaaacccggcagccgagtccttcccttttttcataaaagaattctcatcgtaagccatgcgctcccacagcaatctgccgcctgatggaagattcagctcagcggcgtcgcccgtttcagtctccgtcagccagacgagaagctgcgctttcgtcaaaaccgcatcatagttgtcatcttcctcatgcagaatatgttcaaacttcggcaggcacagataatgtgatttcccttttaaaatagcagctttgaccggccaaggaaacatacgctccaaaagcggaagatctttagacatgatctgctgctgcaaaagagtagagtacgtgctgataatgacgggagtttgttccgctttggcaaataaaacagccggaacgagataaccgatcgtttttccgatgccgggcgccgcttcaatcagcgcatgctcccgattgcggaaggcgccaagcacttcatccatcatcgtaagctgtcctttccgcttttcatagcgggggatgatgccggacaagatctgttctttttcttcgttccacttttcaaggtcaatggccgcattcaccggacgggaaaccggaatgtgatcgggctctttaattgaaaaagaggcgtatggaatgcagctcttttcttccgccggcctgctttcatgaataaaagaatccaaaagcagcgtcaaatcgctgataaaatgctgtgaaagccttctaagctgctttaacgtcggtaaaggcagatgtttcagtttatgtaaaatgtctaaaaagaccaggcccgtaacctccgcatcgctgtctgcgcggtgagggcggtcatgaacaatattcagctctgcgcacaactcaccgagcttatatccttcaaaccccgggaaaacaatacgcgaaagctcaaccgtatcaagcacttcacaatccggcagctcatagcccgcttcgctcagttcatgccggacaaatccgaggtcgaaatgaatattgtgggcaacaaaatacgcgccgtcaagcagatgaaaaatctcctctgcgaccgcttcaaacggcagttcattttcaaccattccggacgaaattccggtcagctgttcaataaacggcgggatggcctgattcggattgatatattttgaaaaccgctcagttatttgtccattttcaatgacaaccgctgcgatttgaatgattttatcgccctttttcggcgaatttcctgttgtttcgacatctatgacaacgaaccgttgtttgttcattaaaatggacacctcaattcttgcatacgagaaaagtgtaacacgttttgttgagaaatggagcggaaaaacagcttttgcccctaaatcttaaaagaaaacccccatgaagggggctcttttacaaaatcgtgtgtgccggctcctggcccagcatctgctcgattttattctgatcatccagaacggccaccttcggctgatggctttttgcttcctgatcagacatcatttgataagaaataataatgactttatctccttcttggacgagacgggcggcagctccgtttaaacagatgacgccgctcccccgcttaccgggaataatatacgtttcaagtctcgctccgttgttattattcacaatctgaactttttcattagcgagcattccgacggcatctaaaagatcttcatcaatcgtgatgctgccgacatagtttaaattggcttccgtcacggtagcgcggtgcagttttccggccatcatagtgcggtacatattatgatctctcccattcatcaatatcaataatgatattatcaatcagtctggctttagaaaattggacggcgcaggccagaatgaccttgccgtttaatgttttaagcggagtcagctccggataagcgtacagttcggcataatcaatgacgccgcttgtgttttcgatgataccggtgacggtttttataacggtttccggatttctttcaccgtctctgaccagttcggcaccttgctgcaatgctttatagatcatcggcgcttctttgcgttcctgctcagtcagatagacgttgcgagagcttttggcaagtccgtcttcttctctgaccgtgtccactgcaaccaattcgatatccataaagaaatcctcaatcaatccgtccacaaccgctgcctgctgggcatctttcaggccgaagtaggcgcgggtcggtttaacgagattgaaaaacttcgtcagcacagtggccactccgtcaaaatggccgacgcgggagacgccgcacaacacgtcagttctccttttcacttgcacggcaacattttgctcgcccttatacatgtcactcggagacggcgtaaacaaaacatctgctcccgcctgttctgcaagccgggcatcgcgctttaaatctcgcggatatgcttcgtaatcctcgcccggtccgaattgagtcggattgacaaagatgctcatcacgacaatatcgttttctttgtttgctttttcaaccagggtcaggtgtccttcatgaagaaaacccattgtcgggacgaatccgatcgtccggccttctgagcggtattgtgcaattaattctttcagctgttgagtttctgtcagttgtttcatcgcttactttcctccgtataagccttgcagcacagtttggtttatctgaaaggaatgcttttcttccgggaaaacccgttctttcacatcacggacataatcgctgagggccgactcaatcgtgccgtcgattttggcgtattgcttcacgaacttcggtgttctgtccacgccgtggccgacgacgtcatgatagacaaggacttggccgtccgcttttgaaccggctccgattccgatgacgggaatggatacttcttctattattttagcagtcagttcagcaggcacacattcaagcacgagcatcatcgctcccgcctgctcgcatttgatactgtcttcaatgagctttttcgcgctttgctcatcttttccctgcactttatatccgcctaatacgccgacagactgcggtgtgaggcctaaatggctgacgacgggaattccgccgagagtcagcgcgcggatggattcgaaaacgccgtctccgccttccagctttaacgcgtccgcgccgctttcctgaataatggccgcggcgtttttcaatgtatcctcttttgaaaggtggtaagacataaacggcatgtcagttacgataaacgtatttttcgcaccgcgttttaccgcttttgtatggtgaatcatgtccctgaccgttacgccgacggttgaatcgagtccgagcacgaccattccgagcgaatccccgactaaaatcatgtcgactcccgcctgttccgcaagctttgcctgcggataatcgtaagcggtcagcatcacgatcggctctccgttttccttcattttcatgaaatccagttttgttttcattctgtttctcctcctctaaacggtgaggagatgagccgccaattcttcgcaagcaaaaaagccttctgtaaaataagaaggattcccacttgtttaacgttcggcgaatgtcatccctctgtcccagtccttttttggatcaaggcagacttttcgtaatctctgttctgctgatcaggtgcagttcattatgatactgcccataggaagtataccaaattcacgaggcttgtaccaactaagattaattgagctcaatatcggcagaatagatcttctttataccgtctctcgtttccaaaagaagaactccctcatcatcaatgccgagcgatttcccgtaaaacgttccttgcagcgttctcgctctgagctcgttccccagtccgaccgcatagctttcccatagcagcttgatcggtgtaaagccgtggttcaagtaatcctgatagcgtttttcaaaagtcagcagaatctcttgtatcagacccgctctgtcaattttttcaccggcttccatgctcaggctcgtcgcaatgtcctgaagctcgccgggaaaatcggtttcctgctggttcacgttgatgccgatcccgagaataaccgaacggacacggtcctcttccgcctgcagctcagttaaaatcccgacggcttttttgccgtgaatcattaaatcattcggccatttaatggcggcctgtacgcctgtaaaagcctcgatggcctgtacgaccgcaacggcggataacagggtgagctgcggcgttttttgcaaaggaacgtcgggtctcagaatgaggctcatccaaatcccgtttccctcctgtgaatgccatactctggccattcttcctctgcctgccgtttgtttatcggcgactacgagggtcccttccggcgcgccgtcattggcaagttcatgagcggttttttgggtggacggcaggacgtcccggtaatgaagctgtttgcccaaaacctctgttttcagcccgaaacggatttcggattcactgagtttccccggttttttaatgagcctgtacccttttcgtctgaccgcctcaacctcatagccctctttgcggagctcctctatatgtttccaaacggcggttctcgagcagccgagcgcgtcacttattttctgcccggagataaagccgtcacccgcctcagaaaataaatcaattaatcgggttcttaatgttgatcccatgatgcgagccactcctttatgtcatgttttcggttaggaagcttccctgccaataccgcttcttcaatccggcgaagttcttcggccacccatttacccgcgcggcggtttctgagctccatcagatcagcgcctgaaatgtcgaggtctcgaaggcttttgatcggcagctgctcatacaggctctgaacctctttcagcttttgttcatcaatcgtcttatgctgtttcagcatcccgattttaacggctgaaaacagcgcctctcccgctcggtacatcgcttctgcttccagctgcgccggataaacgcttatgatctgcaccgctttttttatgacctttcccggcagtttccattgttttaaaaacgcctcggcacttttcggacaaagaccgagaaacaataacagcgctgcccagcgttcttcgcgtgcatctaaagaagaaaacggaaagccgcttgcttcaagcatttgctgctcataaccggaaaggccgggcagctcttgtatcagacctgtctgcaccatcgtttgaatcgcttcttgtgagaaagcgccctgcatcagcttttcaaactcgacggtctttcgttctactgatacatgtgccaaaagctccctgtcttttatgacggcctctcttgtttctttttctaacagaaagccgagctgactcataaagcggacggctctcatcatccgcagagcgtcttcccgaaaacggtcttcagggttacccaccgtacggatcagcttttgtccgatatcatgtgcgcctccgaaataatcaagcagctctccttcggcagacatcgccatcgcattaatcgttaagtctctccgctttaagtcttctgataaagaagtaatgaaccgcacagcttccgggcgccgatagtccttatattctgattcggcacgaaaagtggtgacttcataggtttcatcttcccacaggacgatgacggtgccgtgctcttttcctacatcgacagtccgcttaaagaggcgctccacctcattcggcgaagcgctggttgcgatgtccacatcacctatttttcgtttcatatagctgtctctgacggctcccccgacaaagtacgcctgatggcccgccttcatcagatgatgaaggatggggagggctttgacaaattcctgttccataagatcactccggtcctgccaattcgtcataaatccgttcatactgactgacgattctttgcgaagaaaaggaggtctccaccattttcagcgcatgatcagtcaatcgtttgctgagctgtttatcttctaaaacggcaagcgctttttcagatgccgcctgaatatcgccgacttccaccagaaaaccgcttacttgatctttaatcacttccgggatgccgccgatatttgttccgatgcacggcacgccgcaggccatcgcctcaaggaggacgagtccgaaactttctttttcagacagaagaagcttaagatcgctgatggaatacagctcttccaccctgtcctgatttccgaggagcagcacttgatcctgcagtccgtatttttcgacaagctgccaagcgacgcacttttccggcccgtcaccgacaagcaggagcttcgcctttgtgttggctgcgatattacggaaaacgcggatgacatctttaacacgttttacttttctgaagttcgaaacatggatgacgaccttttcatccggcaaaataccatgtttctcttttatactctctgtatttttcttaagataaacacgttcatcaataaagttgtagatggtctcaatttttttatccggcttgattaagtcatatgtttctccggcaagcgcggttgataccgccgtcactctgtcggacgcttcgatggcaaaacggattaaatcttttaatgacggatcatatcctaaaacggtgatgtctgtaccgtgaagcgtcgtcacgatcccgatgtcacgcttgagcatctgtttggctagataagcgcataccgcatgcggcagcgcataatgcgcgtgaatgatatcaagattttccctcgcggccacctcggcgattttgctcgccagtgtaaggtcataaggcggatgtttaaataccgcgtattgattgacttccacctcatgaaaatgaatattcggatgatatgtatttaatctgaacgggatgcttgatgtgatgaaatgaacctggtgccctttttccgcaagcagcttgccgagttccgtcgcaataatacccgagcctccgacactcgggtagcatgtaatccctatttttaatggtctcattgtccgcccccaaaaacatcatcattcaaaacgggaagctgttttgaaaagaagccttcagcataccccgtcccggcttctttgccatacagtctttcccgcgcttccaccatttcgatataaccgttggtcagcggtgtgttcactgactgcgccgtaggaataaactggctttgataagcgtgcaggctttcttttttcagatcgatggtttccgttatgtcgattacaaagtccggacggtgaaacccgttgatcatataatagtatacgcgctgagccttatgagccggcagttcctgatgatctctgtatttatgaattcccgccgagaacaccgcttcttcgaccaaagccgccgcattgccgtggtcaggatggcggtctttcggataaggcatgaaaacggttttcggccggcaggctctgatgacactgacaatccggcggatgccgtcctcacttttcaaaagcccgcggtcgggaagcgtaagctggattctctcttttacgccgagaattcgtgccgcctctgccgcttcttcttttcttatccctaccgttccgttagatgatagttcggcctcggtcaaatcgcatatcaccgcggtttttccttgagccgtaaattttgcgatcgtgccgcccataccgatctcgacatcatcactatgggcgccgaacgccagaatatcaacgtgttcagacattcggctctcctccgcgcacaagattgcggaaatcaaatgccccgccgtccagcgtccggacaaggatttccgctgttcccatatttgtggcgagcgggatcgcgtatacgtcacacagccggatcagcgcggagacatccggttcgtgaggctgcgcagttaacggatcgcgcagaaaaatgacgagatccagggcgtttgccgcaatcaatgcgccgatttgctgatctccgccgagcgggccggattgaaaacattcaacggacaatccggtcgcttcctggatttttaagcctgtcgtacccgtcgcgtataactcatgatggctcaatatatctttatatgcggtcgtaaactggaccatatcctgcttttttttatcgtgagcaatcaaagcaattttcatttgatgttctcccccttgccgattcagtcgataatattttcgagtccgtatacaagctggtcgattttcatcacttgctccactgacagcttcactcctgacataaaggaagcccggttataggaatcatggcgcagtttcagcgtctggccgtccatgccgaacatgacttcctggtgggcgataaggcccggcagacgcacgctgtgaaggcggatgccgtttaattcagcaccgcgggcgcccggcagaatttctttttcatcaggatggccctgctgcttttctgtacggacgcttgaaatcatttccgctgttttcagcgccgttccgctcggggcatccagcttttgatcatgatgaagctcaatgatttctacatcttcaaaatagttggcggccatttgtgagaacttcatcatcagcaccgcgcccaatgcaaaattcggagcgatgatggcgccgattcctttttcttcagtcaaggcttgaagctcctctaaatccgcttcagaaaatccggtcgttcccacaacggggcggacgccgtgttcaagagcggctttcgtatgttttttgccgatttcaggcgttgtcaaatcgatcagcacatccggttttgtttcttggaaacatgcgcggatatccgtataaataagagcgtctgaatcagctgacatcacttcccgtaatgtttgctgatcgtatgtatggtcaatggcgccgacaagctcaaaatgaggcgtgcggacggcaagttttacggcctcctggcccattctgcctctcggtccggcaatgacgactttaatggtttcatttgacatggtttctcctactttccttcttcttttctagtccagcggtctttatcacgtgtattaaatttatgcatgacgcggttatgagcttcctccaatgaaatatcaagggagttggcgaggcagatcagaacgaacagcacatcgcccatttcctcttccatgcttttctcattttccgtcgttttcttcggcttttccccataataatggttgacttcccttgcaagttcgcccagttcttccgtgagacgggccatcatggcaagcgggctgaaatagccttctttgaattggccgatatattcatcgacctcagcttgtaagtctttcatcgttttgtcactcactgtgcgaatacctcctgtcatctcttccatgttagctaattcaagtacatttgacaaatgttaaaaacggcagtttgctgttttcttttgtatccactataatatttacgcaatcttatggaaggaaaaggggtttgatgcaatgcttggagaaatcagaatcaaaaacatttgctttattttaatcggcgccgctgttttttcattcggactggttcactttaatatgcagaacaatttggcggaaggcggatttaccggcattacgctgcttttatatgcgttattccacatcagcccttctatttccaacctggtattaaacattcctatctttttcatcggctggcgtatgctcggccggacgatgtttgtctataccctgatcggcaccgtctctctttccgtttttctgagtgtttttcagcgctacgaaattcatatgccgctgtcgcatgatttagcgctggccgccttgttcgccggtgtttttatcggcgcgggtctcggcattatttttaaatacggcggcacgacgggcggggtcgatatcatcgctcggctgatcaacaaatttttcggaatcccgatgggccggacgatgtttgcctttgacgcctgtgtcattctgctttctttgtttacgtatctttcttacaaggaagcgatgtacacgcttgtagccgtttttgtcgctgcgagattgattgattttatacaggaaggcggctatgccgcaaaaggggcaacgattatttcttcgaaaaacgatttgatccagcaaaaaatcattgaagagatggagcgcggcgtcaccgttttaaaaggacagggatcatatacaaaagaagacagggacgttctttactgcgtcgttccgaaaaacgaaattgtgcttttgaaaagcgtcatcacttccgttgacccgcacgcctttgttgcagtaagcgacgtccatgatgtgctcggcgaaggatttacgcttgatgaaaataaaaatccgatcagacgataataaaaaggcggcttttgccgcctttactgttcgtgtttccatttgacaaccggtgattttttctttttcaatcggcgggcgaatgccggactgacattgagcgtctgctcgacgaagcgctgcggcgtcagtgccagccattggtttaaggagacgtcttcgaaacggtcgcttttgaagatttccagaaagcgaagcacggtgtcaccggtattctgaacataatgtcccattgcaacaggaacatatcctacgtcacccgcttgatagttaaatgtccgcgctcttccctccgccgcaaacaccgtcattttcgcttctcctgaaaggtaatactgccactcgtccgtattcgggtgccaatgcaattctctcatgcctccgggttcgacctccacaagagctgcagcaatcgtttttgacaccttaaacgtttttgaatcgacaatctttactcttcccccgctggtaacaagaggctcctgccgggaaagcttgtagctgaacggctctaaaacggggccttccggggaagagactgctgcccgctcaattgggggcggcggttccaactggaacatataacgctctttcttgtgaatgtaagccagctcatagcccggaacaccgaagttcgcctccagcacgctgcgcggggtgtgggcaaaccagtccgttactgaaaaggtgctgttttctgaaaaagagccgtcatcaaagacgagcaaaaactcacttccctgctctaatccttgaatggaatgaggaatgccggaaggaaaataccacaggtccccttcacttacgttatcaataaaattccgcccattttgatcgaccgcagttaaacgtactcctccgttaatcacatatccccattcggcttctttatgccaatgaagctcccgcacagctcccggtttcagcctcatgttcaccgccgcgatgtttttggataccggcagttccctgaccgtcacctctctggaccatccgccgtcttcaagcctcatatgcgtatcagaaaatgagaatttcaagttttgaaccgttcctgcatccgttgaaggcggaacgagcatgtcaggattctggaagtcacgcgcgaggtttcgcggtccttcgtcagtcgccccttttctgcctctgatcggctgcgggaggtgttttgaagccaattgctggatgagttttttcactgacttagctcctttacagcaatttgtgtttatttagacttaggatactcacgctttttctctttctttttttccgctctgtattttcggtagccgacatatgtcagcgcagtaataatgataccgcctgttgtcagaatgacccagagcagcgaagggtcagcgtcatcccgctccaccttgtcaaaaacccgctttaaatcctgctgcaggagtgtcagacgctcaagctttgttccttttgtcatctgctgaaacccttcctgctcaatcacctcgatatgtttcgccaccgtatcaagctggccggccgacacatccattgtcaggctgggataaattaaatcatataatgatataaattcattccacttttcattgaaatttccacttccgtttccgctgacatcttcttttaaggcgctgaatgtcgccataatcggtctttcaagcgaaccccacagcggatcggagtggtcttccatcgcatccattaccaacctgaactgggcggctgcccggattttttcggtatctgaggcgtctgcctgtttcaggacgcgcactaaatcattgaagcccagagtcacctgcctgacttcggcgccgctcagtgagtttacgtgtgtcatttttttcttaaagtagccaagcacttgcagagcctcatcatactgcgaatgccgcgtcatttggaaaacggtatccgaaaggtcgttcagttccttgagaccgccctcatcttcagctttggcagttgtgatgaaacacataagagcaagtaaaagacagatcgtcagctttcgtttcatagaggtccctcccactccttctctttacagaatatgaggagcgggacaaggttagaccaagattctatcagtgtaagtcaagctttatccgtcttttagaaatcaccaaatagtatgcaaggccgagtgaaaatatgctcagccagaatgtagcatagccgatctcttgcatatagtcattgagcattgagtagcggggcatcatgccgaaaagataatcaatgacgtcattatgaagcgtccaaacagcagcaacggcaagatgccataaccggaaccgaaaatacgggctgtataaaacgccttgaacggccatggcaaaatgtgaagcaatcagcatatacccttcccaaggcatctgccccattttgaccagcacaaagacattcattccgaccgcccacagcccgtattttacaagggttacaagagccagcgcttcaaacagcggcgcgtttcttcccatgagaaatgccagaagcacaaacaggaagaaaaacgtcgccgtcgggctgtcaggcacaaatatcagaaatcggaacggcgtgtccgcaagctgcggcacataccaataatagccgtacaccgtaccgataaaattaacggcaagaacaagcagaagcatgccgcgcaaccctaaaagataagaaatccacctcataccatcaactctcagtccgtaaaaagtatgtatcatgcaaaaaaagctgacatccggtcagctcttttcataaagtatatcctgctgttgtctacttcacaatacgttatttcgctgtcgtttcagaaatgaacttcgccagctgatcaagctgtttgtcattccctttaaaaataccggctggcatctgccctttccctttgacggcgatttttttaatttcttccgggctcagcccgttatcgaccagggacggaccggcgcctcccccttgaagattatccccgtgacaggaaatacagccttgttctttaaataccttataaccgtctgattcagtatcaatggcggcttcttttttaattttcccttgctcctccgcctttgcccagtcatgtgtcgcgactgactgccacgttaaaaagaccgtagcgcaaagcgccaaaagcatcatcccgacagcaaccggacgcttccacggccttctttcagaccccctgtcgagaaacggagccaaaagcagcgacccgaaggcaagccccggtataatcatcgctccgataacggtgtagctccctgcggcatattcatattttaaaagctggtataaaaatagaaaataccaatccggcagcggaatataccctgtatccgtaggatccgccacccgttccaaaggcggctcgtgcacaatcgttaaaacgagaaacccgacgaggaaaacggccccgaccatccattctttcagcagaaagttcggccaaaacgcctctgtctttccaggatactctgaatagtctttcggtatattcggttttttttcagccggtatccttgaatctcctacaaacttcattcctttcccccggtgcatgtcatcccctcccttttatatcagatttgtattaaagcggtcctgaaattccctgcttgcggatcataacaaagtgggcgcccatgagcgcaaacaaagcggcagggagaaaaaatacgtgaatcgcaaaaaatctcgtcagcgtttgagcgccgacaatatcgtggtggccggcaagaagagttttcacctgcgctccgatcaatggcgtcgcctcggcaatctgaagacctacctttgtcgcaaacagcgccttcatatcccacggaagcaaataccctgtaaatccgagaccgagcatcacaaaaaagatcagaacaccgacgatccagttcaattcccgaggctttttataagctccctgaaagaaaacccgcagcgtatgtaaaaacatcatcacgatgactaaacttgcgccccaatggtgcataccccttacaatctgcccgaaagcgacttcattctgcaaataatacacagattcccacgcgttttttatatccggcacataatacatcgttaaaaacatcccggagagcacttggataacggttacaaaaaacgtcaaaccgccgaaacaatagacaaaagccgagaaatggtgagcgggatttacatgttccggcacttcatggtcggcgatatcccgccacatcggcgtaatatcgagacgttcatccacccagtcataaattttattcagcatgtcacccttcccccctaggctttgcttttccaagatacaaaaagccgtcctttactttttgctcataacggtcaagaggcgcgagcggcggcgtgcccggaacgttcgtgccgtctttttcatacagcccgtaatggcagggacaaaagaatttgttcggatttttaggatcattgttccagtttacggtgcagcccaaatgcttgcagatcggagaaagcgctataatttcatccccatgcttgtaaacccaggctgacctggattcttccgattcgtaccaggcgtcgacttgatgaattttaaagtcaaaccgcttcggctccttcgtcagctcatccacactgacaacctgcaccattttttgatctcccgtcggttttaataccggatccagcgcaaaacggaccataggcataagcgcactggcggccataaatccccccacgccggtgagcgcatagtttaaaaattgtcttcttgatatatcttgttttccgcccatctcttccccccctaaagattgaccaaaaattaactaaaatagaaaataattctgagatttgacaccctcataatatatgaatctttcagcaaggtcaacagaggcaaaacgggtgttttgcaggatgcctggagtttttaagaattgttccacttctgtaacaaaacgttcaaaatttctccgcacttgtcatccgcaatttttctctttaaagagtctttcatatgttcaaacggaacggcaggtatgtatatgacatcagaccctatttcagaatccttccatttttcgtctgccgtcaggaacaaggcgtgcctgaagttggtcatcacctcttctttgagtttttgaagcagggcgatttgtgattggtctatatcaacatatgtataagaggggaataaatatacccgtcccttcaattggcgctcaagctcttcagaaagcaattgggtgctttccccctgttcaacggcctcttttaagcctcctgaagacgttatggaaattaacggaatgacagcggtatcaatgtaatccgcagattgtaaataggcatcggcatcagcggccctccatctcatgtctcgttcctcctctttacgcaacaagccttgcatattctgcaaggctgtcatttatgtgagctgattcaattggcgggaaagcttttcaaatgtttctttgtcgtggcggtccagcgcctcgtcgatatctttaagcagcttttcccgctggaaagtggaaatggcatgttctaatattttttcagccatcccctgatcctgtttattttcaaacaggtctttcggcagatgcggatttgattcaagaacagcggcatattccggtgagctgtaggccgaacggaaattcagctggataaataaatcctgctgtttatttaaccggatgtcgtgaaaagatttttccgcgtccgtagtcatgacattttctttgtaaaacctaaacggcacctcatcaacgcaatgagtagacatgataatgcctctcgggcaaaattcggcttgttctacaaaatggactttttccattaatgaatcatgactcattaaataatttaaaatccagacgcactcccggcgtttaagctgataatgatttaaaaaccaacggataaaatcctttttttcattgacagaaacaggggtctgcatgtaattccctcctctatcgatcgtataatctgacatcacttatacattcagcaagcatggtccaaaatcctgcttatcttaaaaattcatcctctatccgtaagattgtttcttcaagctcttcgtttgttccatccattgaaagcacttgttttaaaagcggcagcgcttctttctggagaccctcttccaataagaagtgagcgtattcatataagaaatcccgatcatcctgataatggagatacgcagcttcgaagctttttttcgcttcagcgtattgctccaggcctgtataggcccccgccaaataccaattgtatttcggatcttcttctccgtagccgcggacttcctgaatcagatcaataatctcttcaaagctttcttctttatgatagacggctaaaagcgtatggagcgcttccacgtaacccggatcgagcgccagcgcttcctgaagaagctttttgccttcctcttcgctgccgagctttaacgccattttcgccgcatagagaaaaagctctttattgtattcatcgtaagtaataccttctttagcggtttttaatgcatcttcatacatgccttctgcctcgtagctttttgcaagcggcatataaagcgatgaataggaaggatcaagcccttttaaatcagacagctgcttgatggctgttttgaccattcccgcctgataggctgtgaacccgtacccgaaaatcgtattcggttctgtatgttctgccgccgctttttcataccatgaaatcgcttcctcaaattcacccgccgcgctcaatgactcagccagcctctgatgaacgtttacgccgccgatttcgtgccgttcttttgccgtctcttcatagtaaggaacggcttttgcatatgatccctgagtgaagtataattcccccagagcgaaatcaataacaggttcatcttgtaacatcgctttcgcctgtaacagcttttgctcacttacttcaaataagccctgcatctgatacagatcagccattaaaaggaggctttccgcgtaagacgggtcttccggagaaatcgtctccagcacctcaagagctttttcttcttcatcaatatctattaacaattcggcgtaaaaattcgtcagctcagactcacccggatagaggtcatgcagatcactgatcagcgctaacgctttttcggcgtttccccattcatagtagagctgggctgcaatggctttgtcttcgtcatgaagctctgtttcagcttttgaaagcgctttgagtcccttttcggtttcacctgcttcaactaattttatggcttcttgaatcaatgtattcaaatcagaccggtcctttcttttcctatacctcatcaaccaaatgaaaagggtttttattcgggttattcttatcataattcagacagggcctgcccgcaaataagatgcttcacccggcattatagtttatcagaaaatggttaagaggaaaacggcaaaaaaggggacggcatctttatacgcaaacagcgcaatttgttccggctgtttctgtaacgaaaacgcattccccctttcttttagttttctgtttaagacaagctatgtcaaagcccaagattttatgacacatgaagaaaaaagcccgaagaatcgtcttcaggcttttttggctaattgatctaaatgctcaaagaatgtcggatatgagacatggatcgcctctgtatcacggatgtcgatcggctcttctgtcaggcatgaagcgataccgagcatcatgccgatgcggtggtcgccgtggcttgacacatcggctccgcccgcaagcgtttttttgccgtgtattttcatgccgtcttcagtcggttcaatgtctgcgccgattttccggagctctgatacgacggtgtcgatccggttcgtttccttcaccttcagctccgcagcgtctttaatgacagttgtgccttcagcctgcgttgccaaaagggcgataatcgggatctcgtcaattaaacggggaatgatttctccgccgatttctgccgctttcagagctgaggtttcaataaccaggtctccgtaaggctccgcactgtccgcttctgaaggaatcacttcaagtgaagcccccatttgctttaagacatcaatcattcccgtgcgtgtcgggttcaggccgacgtttttcagcacaatccggcttccgggaacgacagcgcctgccgcgaggaaaaaggccgctgaagaaatatcgccgggcacgaaaatatcggctccccgaagcttctgaccgcccgttacggaagcgctcgtctccgtttccgcaagctcggcgccaaaagcgttcagcatccgttccgtatggtctcttgatttatgaggctcagtgacggtcgtcgtcccttcagcctgcaatccggcaagcagcacggcagatttgatctgcgcgcttgcaacaggggagacgtaatctatgcctttcaattgtccgcctcttacggataaaggcgtaaaccctccgtccgctcttccgtcaatcgcggctcccatctgttttaaaggctccgtcaccctcttcatcgggcgctttgcaatactttcgtcacccgctaccgtactgtgaaatgggcgtccggctaaaatgccgagcatcaggcggatggtcgtgccggaatttccgacatcaagaaggctgtcaggctcacaaagtgcgtcaatgccctttccgtatatcgttacatcacttccgttttgttcaatggagacacccatttttctgaagcaggcaatggtgctcagacaatcggctccgggcaaaaagttttttaccgttgtcgttccttccgcaagcgctccgaacataacagaacggtgggagatggatttatcccccggaatatgaatttcaccgtttaaagacgtcactttttctcttttcaatgttttccacctcagtcagcgtaaaatgtgtcatatttggcgcgggattgaatgcaggtttccgcgcgcttccggtcatcatcagtctggaaactgattctgagaattccgttaatatcttctcttgtttcgataatgcggatgttggtgatactgattttttcttctgccagtatcgccgtaatttccgaaatgaccccggatgatcgggaacatcgacataaaggtcataaaaggacgggatcgctcctttttgacggagcggcaggccgtcgcgataatctttcgcttttttaaaatatccgaacaggctgtccgcatcttcattttctacataagattcgatcgtgtcaatctcccgtttccattctttgaagcggtcaagcagtttatctttgttatgaagaagtatgtctctccacatcgccggactgcttgaggcgattctggtgatgtcccgaaaaccgccggctgcgaaacgcttcaaaaacggataattttcttcagaatgatgagcctgatggacgaggcttgcagcaacgatatgagggaaatggctgatgacgctcgttacgccgtcatgctcctcgggagtcatctccacaaagtgggcgtttgccgctttcaaaagctccttcagatgcgttactgactctttagaagttgattttccgggtgttaaaatgtaaaacgcattttcgaataaaaattctttggcggcagcggccccggatttatgagaccccgccatcggatggccgccgacaaattgataatgagccggaagcactttgtcggcgtagctgacgactttctgtttcgtgctgcccacatccgtaatcaggagttcatgggtgatgtctgatgcggccagcatatcgagcattttcagcgtttgggcgacaggcgtggcgataatgacaacagacgcttgctgcgccccttccgtcaatgagccggcccgctcgtcaataattccgagcttcagcgcggcagtgagctgttcttccgaaatatccacaccgataatccgtttatgcggatgctcctttttgatggccaatgcgatcgatccgccgatcagcccgatccccgcaagcaatatagtatccttcatttcactcatttcctttttcaactattttaatagagcaaagaggtgatgcttgatcacctcttataatatttcagctaagattgtgagaatttcctcattctgctctttcgtaccgaccgtaatccttaacgctgtcggaaatccgagcgcctgtcctgaacggacgatatatcctttttccaacagggcttggaacagttcatccgccggacggttaaaatcaatgagcacaaagttggtttgtgaaggataacaagttaatccgtgagtttccgcaaaatcataatactgcttaaggcccgctttatttttctcgacgcattcctgaataaatgtgtggtcgtcaagcgctgccagtgccgaagcctgaccgattctgctcgtattgaacggctctctcgccggttcaatctggcggatcagcgcttcgtccgcaatgccgtatccgacacgcagcgcggcaagtccgtacgctttagagaaggtgcggaggatcatgacattcggatattgctttaaaagcgggatgctttcagggtaatcgtccgccgtaacatactcgtagtacgcttcatcaagtacaacgagtatatgctcgggaactctgtttaaaaaggcaattaactcttgctcagaagtatatgtccccgtcggattattggggttgcatacccatatgactttcgtctcgccgtcaattgcttccagcatccggtctaaatcatgagcgccgtcactgcggagcggcacctcgcgcacctcagcgccttcaatcaccgcattgtgtctgtattgcgggaaagtcggggcggcggtaatcgtgtttgcctgatcatttaataaagaacggcagataatctgcactagctcatcagagccgttgccgaaaatgatcgaagattcactgacctgcagatgctcactgagccgcgttctcaaagcggcactgtaaccgtcgggatacagcgcaagctgctcaatctcctgatgcagcgcatcttttgcggcctgtgaacagccgaacggattttcgttagaagcgagttttactactttttcaagcccgtattccattttcacttcttctattggtttgcccggctgatacggtttcagctgccgcagctgttctttaatctgcaaatccagtcacctcattttacactgtacagtcgtccgaacgtcttcgcgtattcttcaaattcaagaagcgcatcagctcttgtgccgggattcacaagctttgttttaagctcttcaacttttttgacaagcgcgctgccgacaacgacaccgtcagatatttcattcatcccgtcaacctgtttgcggtttgaaatgccaaaaccgaccgccaccggaacagagctgaattctttcaccttacggatgaaagagtatacagacggatcgaattcgctgcgtacgcccgtcactcctaaagaggatacacaatacacaaagccgcaggcctgttcagtaattattttcaaacggtcttcacttgtcggcgcaaccagcgagatataagcgatgttctcctttttgcatgtcatttgcaaaagggcgctttcctctaatggaaggtcgggtacaagcaggccgtctatgtcgttttcccgcagtaaagcgaaaaagtattctttttctaattgtaacacaggattataatacgtaaagaggataattggaatatgaacgccgttttttttcattttgccgccaagttcaatggcttttacgatattcattccgttttccagagcccgttttgaagcccgttgtatgacgggtccgtccgcaagcggatctgtgtaaggaacgccgatttcaagggcagaagcgcctgcattctgtaatgatattgccagttcaacagaaatgtcaggaagcggatcgcccgctgtgataaaagggataaacaatttttcagaatctcgcagattaaacatgtgtctccaccccgttttccaaaacattcatcagcgtatgaacatctttatctcctcttcccgacaaactgacgagaatgattttgtctttatccatgtcctttgccatttcaaacgcttttgccagggcgtgggcagattcaatagccggaagaataccttctgtttcagaaagcagacgtaacgcggcaatcgcttcatcgtctgtcacgctttcgtacgttacacggccgcttttgtgcagataggcgtgctcagggccgatccccgggtaatcaaggcctgctgaaatggaatacggttcgataatctgcccgtattcatcttgtattaaataggtcattgatccgtgaatcaccccgagcgtcccttttgcgatcgttgccgcatgcagcggcgtatcaatcccttttccggccgcctcggcgccgatcagctcaatgtcttcgtctaaaaaggcctgaaatatgcccatcgcattgcttccgccgccgacacatgcaacaaccttgtccgggagcgttccttcaacccggcggagctgttctttcgcttcctcgccgatgattttctgaaattcgcgaacgatatacggatatgggtgcggacccactacagaaccgataagatagaaatgatcttcacaatgctggacccaatacctgattgcctcattcgtcgcatctttcagcgtgccgttgccgcttgtgaccggcaccacttccgcgccgagcagtttcatccggaatacgttcagcgactggcgcgcaacgtcttcttcacccataaaaaccgtacatttaaaaccgaattttgcggcggctgtcgcggcagccacaccgtgctgtcccgcaccggtttcggcgatgattttcgttttgcccatctttttagcaagcagaatctggcctaacgcgttgttaattttatgagagccggtatggtttaaatcttctcttttcagatagattttcgcccctcccaaatactctgacaccctgtctgcgaacgttaatgcagtcggtcttccggagtaatcaaacaatagttttttatattcggcatgaaaaacaggatcattttttaattctgtgaaagccgtttcgatttcctcaaggggccgcatcaatgtttcagggacaaatttgccgccgaattcgccgtatcttccgatttcatttggatatggatacatagtggttcatcctttcttctaaaagccggatcagtgtttgatccttgtgtccgtttttttcaattccgctggcaagatctataccgcacggacgcgttctcagtaagccggtaatcgtttcaggattaacaccgcccgcaataaaacagcgcttgcttgcattttgagcctgctttcggtacaaggggacacgggcccatgaaaacgcgattcccgtcccgcctctcattcctgtcactgaagaatcaatgacatagccgtcgacagcaggtgtaaattgagccatctgacggagcgtcccttccccgtgatggagcgctttccatatttccgagcgcacaagcggacggaggcgaagggcatcctcaggcgattcatcaccgtgaagctggatgacgtcaagtgccagatcagatgcgatttgcgcgatgttttctatcgtttcatttacaaatactccgacatgtttcttgtctgtccggacctgctctttccatttccggacctcatccggcgttactctccgtttgcttgcggcaaaaataaatcccagataatccgcttctgaagctgccgcaagttcataatcacgcttcgatcgtattccgcagtactttaactcaggctttttcatatcgtcactctccgaacagtccgcggatcgccttttgctgcgaatcctctctcattaaggattctccgaccaatacagcctgcgccccgtgcttgttgacgaattgcaggtcagccaaagaaccgatgccgctttcgctgaccagcaggcagccgtccggcacaagctgcgctattttttccgtttgcgaaacagaagtacggaacgtttttaagtcccggttgtttatgccgagaatgtccggctgaaacacttgtaaaatccgttcaagcacagtttcatcatggacttcaacgagaacgtccatgcccttcccgcgggcttccagataaagctcatgaagctttggaggttccagcgcttccccgatcagcaaaatggcatcggcgccgatcctgaacgattcctccacctgaagggaatcaataataaaatcttttctcagcacgggaagagacacggtttgtttaacatctgtcagaaattgatttctcccctgaaaaaaacgggtatccgtgagaaccgaaagggcgtcggctttagccgcttcataatccgccgcaatcgtttccggaacaaaatgctctttaatcaatcctttagacggcgaagcttttttcacttcggcaatcagcccgataaaacggttcgggttcaggagcgcttctttaaaggatctccgttcaatttgacaggtttccggcagcacgatggatttgatttcttcttttttctgcagaatgatttgatcaagcatacatttcttcctctttctgtttcagacgttcgagctgccttttggcatctccgttttgaatggcttctaaggctgttttcgttccttctttcagatcgtttgcaagacctgccgtataaatggccgcgcccgcatttaaggcggtaatatgcagagcggatgacggagctctatttgcaaaaatattctgaatgagaagcgcgctttcttccgatgaactcacttgaatatccttcaatgaaccttctgcaaaaccgaattgttcaggtgaaacggaatattccagacgttcaccgtttttcagctcaatgatatctgtcggtgctgtgatggacagttcatctaatccgtcacgcgccgacacaagcatgacgtgtctgacatcaaattgttccaaagcgcttgccatcaggcgcgctttatcaaatgaatagacgccgatcacctgccgcttcacctgcagcgggttgctgagcgggcccagcagattaaatacggttcggaagccaagctcttttcttgcggcggcgacgtgcttcattgacgaatgaaacagcggcgcaaacaaaaaccccatttgtttcatttcaatgctgcgtttgacgctttctggagtggcttgaatggaaacccccagcttttccagcacatccgcgctgccgcttttagacgaaacggagcgatttccgtgcttggcaactttagctccggcggcagaagctgtaatcgccgctgccgtggatatgttaaacgtagaaatcccgtctccgcctgttccgcacgtatcaacgacatccgccaagccacccgccgtctgtgcccgcgcccgcatcacttttacaaatccggcaagctcctccgccgtttcaccccggtgggctaataccgataaaatcccccgatctcagactgcgacatggccccgttcatcatcatctccatcagcttttcggcttctccggttttcagcgtgcggccattaacgcacgattgcagaaatttgttcatccgtcttctcctccctgccagaaaagatgtcttctgcgatttgaatcgtttttaaaagcgcccccgctttgttacagctctcttcatattcggcttccgggacggaatcagcgactattcccgcgcccgcctgcaccgacgccgtaccgtttttgacactcatggtgcggatggtgatacacgaatcaattgacccgtcaaatccgatataagcgatacatccgccgtaggtttctctggaagtcggttctaattcatttaaaagctgcatcgcgcggattttcggagcgcccgagagtgttcctgccgggaatgccgacatcagcgcatcaaccggatggacgccctgttttaaacggccggttacaacagagatgatgtgcatcacatgtgaaaaagaaacgacctttgtgaattccggaacggctacggaaccgtactccgcaactctgccgatgtcattgcgcgcaagatcgacgagcatataatgttcagctttctctttttcgtcattcatcagctcttttttgaggcgatcgtcctcttcttttccggcgccccttcttctcgttccggcaatcggatgaatttccaggtgtctgtcatccacgcggatcagacgttcaggcgaacttccgacaatgtctctgtcaggcagtttgatatagtacatataaggtgaaggattgacgatgcggagcaccctgtacagctcaaatgaatgtctggataccggaatgtcaaacttttgcgaaagcaccccttgaaaaatgtctccggcttttatatattctttcagtttattgacgccggccataaactcttctttcgtataattagatgtcatatcggcaaaacttggcgtttcaaatgtttctttagaaaaaaacggctctttcatatctttcggttctgtcaaaataccgataagcttacgaagctccgcgcaattttctttaaaaacggcccgcttttcttcctccgtctcccggccgttaagcgccgcatattgaatgaaatgcacttgtttcgtttcgtggtcgtacgcgatgattttccggcagacaaacagcatgcatttttcgaaatctgtttctttcgcgtggctcggcacggtaggctcaatcaaagggatcatgtcatagctcagataaccgacggcccctcccgaaaacgggatatcaagctcgggtgttttaatgcggaagctttcattcatccaatcaagcacggcttttaattctccggcttcaaacagcgtatgcccgtttggatcagcggcagtgaatgtgtgatgactctctttaatcgtgataaaaggatcgaggccgataaaagagtatctcgaccagcttgacgactcatccttgctttctaaaagatacgtaatgtttctgtccagtttttcaaccatctgaatgggtgtgatcgtgtcgaccgtaaaagtctctgcgattggaatggtgcggtgtgtcagactgtcctttaaaaataaagaaacatccgattgtaaattcatgattctcctccttacggtaaggagaatgagatgaagagtgagaggagtcttgcgtataagaaataaacccaaaagaaaggcttcttttgggcagaataaaaacgtgtttatctcagctcagctaaactcattctctgctaccctattctaaactcaactgttcaatatcttacttaccagctctatacacactcttgtgtatttctaagctttgtttatcgtattacatgtcagtattttttgtcaatgataaatccggccttaacacaacggctttttctaaatagacatgcttgatttcatcctgaggcgtatccgtctgaaccgtcatcaggacacggatacacttttgcagagcgccggtgacatccatttcctgcatgcacgtcaccgggacgtactgccacccggaaaggcggcggaccgcttttgccggaaatacggaatggatatcaggcgtggcggataacaggatctgtacaacgtcttccggcttgcatccattttgttcaatgattttttcaagcagctgctgtgttttttctaaaatttcttgttcggtgtcttgttccaccgttgttgctccgcgaatgccgcgtatcatcatgctgtttcctccattcgccatttgttcagcaaattttcgagctcatcttttgaaagcatgcagtcccgcgcttcccctaattcctttaacacgatgaactgtgtcatgcctccgcgcgtttttttatcattcatcatccgggcggagagaaccggcgtttcaatatcttgtctgatacttcccgggtagccgagcccaatcagccattgtgtgagttctttcctgttcatcttgcaacccgcaacctgttcactcacgtaaagggcaaactgcatgccgagggcgaccgcatctccatgagtaatccggccgtagccgtattccgcctcaacggcatggccgagcgtatggccgaaattcagaaaagctcttatgccctcttccttttcgtcctcacgcacgacggccgatttgattgaaattcctttataaatcatttcattcagctcagcgcttgtcagtccttgcaacgtgtcaaacgtgagaagtttttctaaaaaagcatgatcggcgataaacgcgtgtttgatcacttcagccatgcccgatctcagctcttgttccggcagggttttcagaagctccgtatcgtaaatcaccgctttcggctgataaaacgcgccgattaagttctttccgagtttatggttgacggccaccttgccgccgaccgcgctgtcatgggcaagcagtgtcgtcggcatttgaatgaaatcaattcctcgcataaaagtcgctgcgcaaaagccggtcaaatcacccgtcacgccgcctccgaaggcgatcatacatgaggagcggtccatatggaaagcgatcgcttccgtttgaatccgttcatactcttttagagacttcgcttcttctccgcttggaacgattacttttttcacgggccatgtttcgtttaaaagccggaacatctcatcgccgtaaagccggtcaacttcagcatcgatgacgagaaggatctttgtcagcggcctgttcagtgaagacaaaagagcagcggcctgtttccttatgccttcaccgatatacacgggatatgcggaggaagctgtccgaacctcaagctctttcatcagaattccctcgatagttttttcatgttttcaacattttctttaatgcggtcgatctggtcaagcccgaattgttctacgacggcatttgcgatttcccaggccactgcagcttcagccactacacttgctgccggaaccgcgcagctgtctgaacgttcaatgctcgctgtaaatggttctttagtttcaatgtcgacgcttttcagcggcttatacaaagtagggatcggtttcatgacgccgcggacgacaatcggcattcccgtcgtcataccgccttctaatcctccgagcctgtttgtggcgcgtgtatagcctttctcttcatcccatacgatttcatcatgaacttcactgccgtttttgccggccgcttcaaaaccgatgccgaactctacgcctttaaacgcgttaatcgacagaacggctgcagcgagcttgctgtccagcttacggtcatagtggacataacttccgacaccgacaggcataccttcgacgatcacttcaacgattccgccgatcgagtcgccgtttgccttcgcttcatcaatggctgccatcatttgacggcctgcttcttcatcgtagcatctcaccggtgattcttccgttacccgtttgagatcctcaatggatgtgtaatcggttttctctgcttttacgctgccaatttgcaggacgtgtccggcgactttaatgccaagctccgctaaaatctttttagcgacggctccggcagccacgcgaaccgttgtctcacgcgcggaagatcgttctaacacatttctcatatcacggtgattatacttaatagccccgttcaaatctgcgtgtcccggtctcggtcttgaaatctgacgtttcatttcactttcttcttcttctgtaatcggtgcggcgcccatgatttttgtccagtgagtccaatctttattctctacaacgagcgcgatgggtgaaccgagtgtccgggcatgccgcacgccgcttgtgatcttcgccctgtccgtttcaatctgcatgcggcgtccgcggccgtgccctttttgacgtctggcaagctcaaaattaatgtcttcttcagttatataaagccccgcaggcacaccttctataattgtcgtcagctgcgggccgtgtgattctccggctgttaagtatctcatttctttcttctcccttcatcgcattaacgcttttaagtaaaactataccacaagttttcattaaatgtcttctatcttttttgataaaaaaatgtatcagtgctctcaaggccgaatttttccgggctgaaaatctgctctgtgcttccgacaaacagaattccgttctttttcaggctgcccgccatttttacatacagctcttcttttgctttttcagtaaaataaataaagacgttgcggcagacgatcagatcaaaatcctgttcatagctgtcggcgagcagattgtgccgcttaaaccggatgtttttttgaatctcttgttttacttgataactgttgtcagcctgcttggtgaaataacggcttttcacggaagccggcacctcttgcagcgagcgttcctgatagatgccccgcttggctttgccaagcgccttttcatcaatatctgtcgccaatatatcaaatccggccaaacccgcctgctgactgagaatcatagccaaagtatagggttcctcccccgttgaacaggccgcactccatatttttaacggtttgttatgctttattaacggaagaattgaggtttcaagaacttcccaccgtttataatttcggtaaaattcagaaacattgatcgtcatcctgtccaatgtttcatttaataaaagcttgtctttctccaaagcggcggcaaattcctgaaaatctttgaatccctttttttcataaagggacgtcagccgccttttcatctgtgcttctttgtataaagataaatcaacgccggttatttgtttccacttggtgataaaaatttcgtaaggctccattgcttctctcccaatctcgctgtcttttgtcctagtatagcctgttttctttctaatttgtacgatttcaataaaaaaatcagcccgcaggctgatttgtgagaaatgaaaagacagggcagcgcagcctctgtctttcttaaaatatgtaaaccttttcataacaagagaaaaagaaaggctgacggcttagtacacccagtcggccattaatttttgatacggtacaagctcttcccgtttgaagaaaatgtcaatttcccgctcggcgctttctaaggagtctgaaccgtgaatgatatttttgccgacaaacatgccgtagtcaccgcggatcgtgcccggcagtgcatctttcgggttcgtttttccgatcagctgtcttgtgatctctactacattttccccttcccataccattgcaaatacgggtcctgatgtaatgaattccacaagctcgccgaaaaacggcttccctttatgttcagcataatggttttcagccatctgttctgaaacttgcattagcttggctcctgccaattgtaagcccttacgctcaaatctggataaaatctctccgatcagctggcgctgtacgccgtccggttttaccatgataaaagttttttccataagattctccaccccatcattatgtataggctttcaagttgcacaccgaaatcgtaacatctttctgacaattaatcaatccagggcggagaatgttcacatcttgttcgtaaaaggaatttaaaatttccgtttgccgatatatttggcgatggcggccaatgatgagcgcgcccgtcctctcggcagtgtattcagtttttcaaacgctttttttaagtacctgtcactgacggccattgatttttcaattgcgtctgtgcgtttaatattttcaataatgggggcgagctgctcctgtgttgtttcactgttaattaatttcagctgatttttcaattcaggctgacggagcgcgtacaaaacgggcagagtgacatttccttgcagcagatcccctccgaccggctttcccagttcctcttccgttgaagtgaaatcaagaatgtcgtcaataatctggtaggacatgcccacgtaatagccgaaccaatataatgctttgtgaatcttctcatcagctcccgaagcgatggcgccgagctggcagctgacggcaatgagaagagccgttttccgtttgatgcggcgcaaataggttctgaggttttgttccatattgtatttatctctgatctgttcaatttctccgaggcatacttctacgatggttttggacaggatccggtgggctttcggctcatccaatctcgtcatcatctcaagtgagcccgcaagcatataatcaccggtatacatggcgatacggttgtcccacttggctttgatggtcggttttcccctccgcagctcggcgtcatcaatgacgtcgtcatgcacgagggacgccatatgaatcatttccagcgtcaccgcaacatattttattttattaatgtcatagtcgccgaacatgccggaaagcaatacgaaaacagggcggatccgcttgcctcccgcctggagcagatggagcccggcttcactcagcaagggatagtctgaccgcaccgtttgctcaagttccctttcgatcacatcaatatcgtcatttaaaaaagaataggccattttaaatttcatatcattcacccaaacatctgtatattcatcatttccaaccgatatgcgtagcggccactccgccggtaaacgaatggtatttgacattcgtcaggcccgcttcttcaaacagacgcgcaagctctttcataccgggaaattctcttgccgattcttgaagccaagaatattctttatagctcttcgcaaacatttttccgaagaaaggcatgatgtatttaaaatatagaaaatatgcctgtctgaatccgaacatttccggctgggatgtttccagacatacaacctgcccgcccggtttgacgacccgccgcatttctttcagcacggtcagatagtcgggaacgttccgcagcccgaagccgatggtgacaaaatcaaaagaatcatcagcgaagggaagctccatcgcatttccgtgcaaaagctcaatttggctgtaaccgccctctttcacttttttctcgccgatgctcagcatatttttgctgaaatccagtcctttgatttcgccgctttttccggctgcttctgcgagggcaatcgtccagtcagccgttccgcagcagacatcaagcgcttttgcgccttcttttacattcatgatctgcatcgttttatcgcgccattttttatgctgctgaaaactgataacagagttcatttggtcataatttttatagattttttcaaacacgccgtgtacgcgctgttcttttgactcctgcatgttgattacccttcttccactttctgatgatatgttttgtcctggctgatcgctttgagccggttcagcatgaggttttggattggtgaattgagcggcagcagcgtttcaatgctttgctttgcctttcggaagctatcttccattatgtcagcctttgatttccctgactttacaatattgccgatgacatcgagaaatatagcattgccgttcatcagccgcttatatacaaaaaaatcactcgccagctctttccagcgcggaagattaaagtggtctgacactctgtgaaacagggccgcttccacaatcgccatgctttcgatcaattgattcaagtcattgacagaccgatcgtacagacggattttatgctcattgatttctttaattgccgtagcgagcgtccgaatcatatagatatccttcatttcagataaaagcgaataatacagtccgctgaaatagtcgccggcaagcacggtgagctgccggtttttattttcgtctcgctttaacgctctggctgttgtcacttcatcgtgggtatcaagggcgctttggacaagcatcgcagttactatgtaattttctctgtcgttgttcttaatgtccgcctcttcaaacaaagcgtgaaaaagaagaagcttatcctcatcgattttaggcgcggaaatatgtttcgctaaataaggatgagacagcttttgttttaatttcgtatttagattcgttaaagttccgtagatgtcttgcaaaaatatcacccttgtccccaaattcacatttattctaatatgtatgagatttactcgtcattattatacgcaggtatcattatagcataaaaaaaagaaattggctgtattctcccgccgtttgcgggcaattggcaaaagcgggaaacagccggcttattttttttcgctgttcatttctccgtaagcggtctggatgagggcgttgcctctcactttgatggcagaggtatgctcagtaaactgagcgataatcacttcgcctttgtccagtttttcggaatggtgaaatttcgtatccgtacctctcgttaaaccgatgacgttcacgccgtcctcgaccgctttaatgacgacaaaatcacttgaatgctttgaattcatatctgcaccctctatcattattaatccgcacgtttaatatgttctaacacttcggaacgcgccgctgcgtcatctttaaaaatacctcttacagcggaagtcactgtttttgcgccaggctttcttacgcccctcatcgtcatgcacatatgctcagcttcgacgacaaccatgacgccgtggggatctaaggtctctacgatgctttctgcaatcgttgaagtaatgcgctcctgcagctgcgggcgttttgagacggcttccaccgcccgcgccaatttactcaggcccgtcactttgccgccgcgcggaatgtaggcaatatgcgcttttccgtaaaaaggaacaaggtgatgttcacacatggaatgaaacgcgatatcttttacaagaacaagctcctcatgctcttctccgaaaacggttttaaagtgttctttcgggtcttcatttaatcccgagaatacttccgcgtacatttttgccacgcgtttcggcgtatctaaaagcccttcccggtccggatcttctccaatcgcctctaaaatctggcgaaccgcctgttcaatctgttctttattaacttctttcattgtctgtgtcctccaccattgaatacatttaatttcgattctagcacatttgccgcgccaaaagcaaaacgaaagtcctgcccggtgaccggggctgcttaaatatgaaaagcccctttatcaaggggcttttctgtgaagaaacaaagtgtatgtatcagatgcatacacgatctatattcacaattattttcctgcaacagcgtctttaagagctttacctggtttgaaagcaggtaccttgcttgcagggatttcgatttcttcacccgtttgcgggttacgtcctttacgtgcagaacgctcgcgcacctcaaagttaccgaaaccgatcagttggattttatcaccgtttttaagtgcatctaaaatcgtatcaaaaacagaatcaactgcttttgtagcgtcttttttagacaattcgcttgcttcagcaaccgcattgattagttctgtcttgttcatgcctttcacctcctcccaaaagggtatcaaatcagcagtttattatcatttcttcacagttcagcctgattctaaacctgtctgataaaaaatcaaagcagggaagaacagacaagtaaacggcttttcataagaaaacagacactttgaggaatgtttgtccaacaaagtgaagattttctgtatgtagagtaacacatataaaaagccatatcaagcattttaaagcctcaatcccttgctcgtcaaggttttcacgtgttttaccgaacaaatattcctttttttgcttttttcctcctaatccttgattgatttccagtatctaaaaagaataaaaaaagaccccccgtttcaggaagaggtccttcagcttacaaaataatggcgatcaggccgcctgagccttcgttaataattctctccagcgtttctttcagtttgtatctcgcattttccggcatgagtgacagttttgcggagattccttctcttacgatagagctcaatgatctgccgaaaatatcggaattccagatagaaagcggatcatcttcaaagtcctgcattaagtagcggacaagctcttcactttgtttttctgtcccgatgatcggtgcgaattcactttccacatccactttgatcatatgaatggacggagcgaccgctttcagccttactccgaaccttgatccctgcctgatgatttccggttcatcaaggctcatatcggttaaggccggggcggcaatgccgtagccggtctgtttcaccattttcagcgcatctgatacctgatcatattcttttttcgcgtgggcgaagtcctgcattaattcaagcaggtggtctttcccgcggatttcaacgccgaccacttcttttaaaatctggtcatataaatgatccggcgcatacaaatcaatttctgcgacaccctggccaagttcgattccggccaatccggcgctttcaataaactcaaattcactgaagtggccgacaacccggtcgacatcgcgcaggcgtttaatatcttttacggtttctttcactgattcctggtagctctctctgagccaatgattttctttcagcaccatgacccagctcggaaggttgacattgacttccagcacagggaactcgtaaagcgcttctctgaggacgcttaacacatctgtttcccgcatgctttcaacactcatggcgaggacgggaatatcatatttcgcgcttaattcagctctgagcgcttctgtttccgggtggtacggttttaccgagttgatgaccataataaacggtttgccgacttccttcagctcgtcgatgactctttcttccgcttccacgtaatcgccccgcgcaatatcgccgattgagccgtctgtcgtaatgacgaccccgattgtggagtgttcctggatgacttttctcgtaccgatttccgcagcctcatgaaagggaatcggttcttcataccaaggtgtattgatcattctcggaccgttttcatcctcatatcccttcgccccgggaaccgtatatcccacacaatccacaagacggatgttgacatcaagtccttccgcgacatgaacggacatggcttgattcgggacaaattttggttctgtggtcattatcgtttttcctgctgcgctttgcggaagctcatcctgcgcccgcgctcggtcggcctcattgctgatattcgggagcaccacaagctccataaattttttaatgaatgtagatttccctgtacggacagcgccaacgactcctaagtatatatcgcctcctgttcgttcagcgatatccttgaaaatatcgaccttttccaagtgatcccctcccggacttcctatccttatcatttttcattcaccattctccaatcaaatacaggacactatatgtgtatgacgttgtcctatttcaatatgacatctttagaaaattttcaggcagtcttttctatcaaaatcaaaaaaacctttctccctatttgtatgcgcgggaaaaaggttcattcctgtttcgtttgactttctaaaaaaacgggttcctgtttttcatttacggtgtaagtgactgaaaaggccgggacgaaaggagtctctttccataaaatatcctgaatttccgcgcccggtttgattttctttttgttttccttcaggcagcgggcgagatcgacgcgatagtcggcatagatttctccgtcagcgccgattaaaagcggcagagacgtgcctgaaaccggacttttgactgaaggagagtctttcatgccgagcttttttttatttaaagtgaacaggccttttgaaacagcgtcctcatagggaggatatgtatgcttttcctgatacattttgacacgcagcttcatgtcgcggattgcttccgccatttggagatcgaccagcttgacggtaggcttattttccacatcgacaagcacgtattggtacattcctccgctttcataagctgaggccggcggctcctctatgtatctgggcgcgagccgcttaaaatctatcggatatttttgatagagcggtgttttcatatcttttgtctgaatcggcagaagtccgccgttcgcctttttaaattcatccactgccgcttgcacctgctgaagctgatgtttgtaagatactttattttcagttttttttgcttcagggtacagacagcccgacagcagaagcaccgccattgccgttatgacggccatttttaacttatgcattccgcgcccccttttggctttattcattgacaggcccgctgaaaacgaccattaacacgatcaatcccgagatgaccatgcaggcataagcgagtgaagaaaccgctgcttttatcagtttgtttttcactttgtacctgctgacataaataaaggcgaccgcaacaaacattaatcccatagcaccaagcgcaaaccacattttcatcaatgccacactcacgttcgtgccccccgtcccatcattgtaagcgttatatttcattttaatatacaaatgttgaaaagatcaacaggttttccatctattgaaaaaacaaaaaaactgaagcaaagaggggactttgcttcagtcaagttgactatattcacctgtacgtctgagatacactctcttggacttcgatgctatagtatgcgtagatgcgtacgtctgcatcctcttctgcctaaatcagcaaatgttttaagcgatttcagccggagagttctgcgttttggactttcgtcacttcagaatatgctgacggcatgttattgtcacttcacccggttttcgaatgtgttgaccaagtcttccatctcatgggttttcactctggccattaaggattctacggccgtttctaccttctgcccattaaataatacttggtgaagcgcttctgtgatcggcattttcacctgatatttttgagacagctgatacgcagctttcgtcgtccgcacgccttcaacaaccatccccatcttatccaggacagcttccagcttatatcctttgccgagcaggttgccggcgcgccagtttcgggaatgaacgcttgtacacgtcacgattaaatcgcctacgccggtcaggccggaaaaggtgagcggatttccgcccatctttgtgccgagtctggcgatttcagcaagacctcgggtgattaaggccgcttttgcattatctccgtatcccaatccgtctgtaatccccgctgcaagagcgatgatattttttaacgctccccctatttcaacaccgatcatatcgggatttgtatagacgcggaaatgctggttcatgaataaatcctgaaccgcttctgcagccttgatattttttgaagatgatgtaacagtcgtcgggtgtcttaatccgacttcctcagcgtggctcggccctgaaagcacgacgatgtcttttctgtactcctcaggcagctcctcctccattaattctgaaatgcggagaagcgaatccggctcaattcccttgctgacatgaacaaaaatcgattgtttcgggatatacggcagagcctttttcagcacttcccgaatggcttttgtcggtactgccacaatgatgaagtcagctccttttaaagcctcgcttaaatcggctgtcccgatgatagaacttgatagctccacacccggcaggtaatctttgttttcatgcagttcgttgatttgatcgatcaattcggcacggtgtccccacatcatgacttgatgtccgttatcagccagcactaaagaaagtgcagtgccccagcttcccgctccaagcattgccacttttttcatctctgtatcacacctttttattttcttgctcttgcaaatattttaattggcgtaccttcaaatccgaaagcgtcccggattcggttttctaaaaagcgttcataagaaaaatgcatcagttccggatcgttgacaaaaacaacgaagctcggcggcttaacagcgacttgagtcgcataataaattttcagacgggagccgttgtgcgtcggagtcggattcatggcgaccgcatccatgatgacatcatttaagacatttgtctgcacacggagagagtggttttcactcgctttaataatcgcaggcatgagtgtatgaatccgctttgtcgtcagtgccgacataaacagcaccggcgcataatcgagaaattggaaatgctcccgaatattctgttcaaattctttcatcgtgcgctcgtccttatcaacggcatcccatttgtttacgataatgacgacggctttcccggcttcatgggcgtatccggcgatccgcttgtcctgctcaaggatgccttcttctgcattcagcacaacgccgacgacgtctgagcggtcaatggcttttaacgcccgcagcacactgtatttttctgttgtttcatatactttacccttttttctcattcccgccgtgtcaacgattacaaattcctgctgattgtaagtgaacgccgtatccacagcgtctctagtcgttccggctacgttgctcacgataacccgctcttcgccgagcatcgcattgacaagggatgattttccgacattcgggcggccgatcaggcagaattgaacgacatcatcactgtacttcgtctccggaatgtttttaaaatgctcggcacaagcatcgagcaaatctcccaatcctaaaccgtgtgtccccgaaatcggatacggttctccaaagccgagcgcataaaagtcataaatgttcgctctcatttcggtattatctaatttattaacggctaatacgaccggttttttcgtccggtacagtatttttgccacttcttcatccgcagacgtcacaccttcgcggccgttcaccataaagatgatcacatcagcctcgtccatggcgatttcagcctgctggcggatctgtgtcagaaacggctcgtctccgatatcaattccgcccgtatcaatcaggttaaaatcataattcagccattccgccgaactgtatatccggtcccgcgtcactccgggggtatcttctactattgaaattctttcacccgcaatccggttaaagattgtggattttcccacattcggtcttccgacaatggctacgacaggtttacccatagtacccttcctttcaatccagccgcttacattttcacaaaaaattgttcaaccggttattaataatcatcttcgctatgaaaagaacccttcaaacagaagggcttaactcatttattatatcagttttcactgagatcacaatgtattcttcaaaatgtttcgtattcatgtaacagtctccgtctgttttcaagacatttttgtcgctcctttgccctgctttttgcttttttggctgatgcgcgccgcaagctgttcatatgtagtcagcccgacgagaagaatcactcccgccgaacagcctgatagccatttataatcaccgacggctgctgcccccgcaatgttgcggatgaccgcagcatacaataactccccctggcacatgccgagaacaaaaagacaaagcctctcagggaaccgcccctcaacagaaagcgtaataacggtaagcagtataaccgctgcccattcaggttttatgataaaccaaacagggtcatataatgcaaaaagaaaaataaagccgtacgccgcagccgccgtcagatgaatcacaatatgacggagccgtttatgcatgccgaggcttcccgcataaacaaatgccgcagcaaaaaacatgacatatgccgcgttcagcgtaaaataagccgttatctgatgtatgcttgccatcatattagtcaaaataaagactgatacgtaaaaacggctttttgttttggcaaaaataaaagtcgcaagtatccataaaaaccacattgaccagtaataataaaacggttccataatcgctcctcctctgaccagtatggagcgggaacgcattttttaaaccaattatgcctgaaaggagcggataaaaatgggaaaagacagacaggagaaaaaactgaaagcctcccgccgggtggaatctgatcgcgatgattcaattcaccataaaggagcgacgagccttgaacaaaacggtgaattccgaaaaagaaaatcgtaaaaaacagagaaaggcatgcgggttcgcatgccttttaacgtctgctgaaacgggatgtgtcaattccccgttcagaaagccagtgatgtgtgtcaccttttatgaccaaaggcgccttttgcaattgggcaaccgattggcatccgagggcggtcataatcattttcagctcttgtaaaagcaccgtcatctcgtcaaacagcccctcttctcctttggaggtgagagctttcaggaaagtgcctgccattcccgcgccagaagcgccgagggcaatcgatttggcgacatccagggcactttgcagcccgccggatgcgataattgattgatcagcggagagcgagtggatttccgctaagcttgcggcagtggaaattccccatgtattaaaaaattgaagcgccttctctctgcgcatattttcaatcttagagaaatttgtaccgccgtatccgccggcatcaactgctgccgcaccggcatcaaataactgccgtgccgactccctgctcattccgaagccgacttctttgacaaaaacgggaactcccgcttccgccgcaatccgctcaatacggccgagagcgccggtaaagcttctgtctccctccggcatgacgatctcctgaatcacatttaaatgaatctggagggcatccgcttgaatcatatcaattgctctttttgcctgctcggcatccgcctcgctgcctaaattggcaaatatcagcccgtccggattctcttttctgacgatctcgtaagaataccgttcggagggatcttttaaagccgacatttgcgaaccgacagccagcggcatgccggctttgcgcgcggctcttgccagcgatctgttaatttcgtatgtaagctgtccgccgccgcctgtcatcgcattgataaaaatcggcgaactgcttgtgagtccgccgattttcgttgatatatccactttttccaatgctaggttcggtaggctgacatgaacaaacgtaatatcatcaagccccgtttcccggttttggccggtagacagcgcatgatttatatgttctctttttcgttctgctcgtgtcacgttttatcaccaatttattttaatttattaagcttgtctccgattaaatcgccaagctggaagccggtgctcggctcttctttcgcctggtattgacggaagtcctcctgatcggctttcggcgcttcttcaagctcacgcatgcttaaggaaatgcgctcttcgctttcgttcacgtcaagcactttcactttaacagtctgtccttcttcaagcacttcatgcggcgttccgatatgtttattggaaatttgcgaaatgtgcacaagtccttccacgcccggaagaatttcaacgaaggcgccgaagcttacaaggcgctgcacttttccttcaagcacatctccctgttttaccttttcgccgatctggctccaaggtcccggcagcgtttctttaatagataaagaaatacgctcgttatcgcggtctacggacagcactttcacttttacgtcctgaccttcttccaccacgtcagacggtttttcgacgtgtgaatgagacagctgcgaaatatgaacaagcccgtcaattccgccgatgtcgacaaatgcgccgaaatcagtcagacgctgcacttttccttcaagcacgcttccaacctcaagcgtttggagaaaatcatgctttttggctgtctgctctttttccactacagcccggtgtgacagaatcacccggtttttatcacggtcgagttcaacgacgataagagagagggttttccctttatagtcagtgaaatcctcgacgaaatgagcttcgacaagtgatgcgggaatgaagccgcgaacgccgatatcaacgacgagaccgcctttcaccacatctttcacttcagcttcaaacacttcttttgtgtcgaattttttttcaaggtcttcccaagcgcggtcagcatcaacggcacgtttagataaaatcaaagcatcgtcttccacttttgttactttcaggtcaagctcgtcgtcaacttttacgacatccgatgctttctctacatgaagacttgataattcactgattggaatgattccggactgtttgacattgacaatttcgacatctacatgcttgtcctctacctttgtcacaatcccttttactacatctccaacctctggcacttgaacatcaatttgattcatttcctctgtcatttgaataacctccttggtccaaacctacacagcttaattaatacggtttgaaagctgaacatgtgaatgtccgcttttcagccgaatatgtattaaagaatcatccaaaaaagattttgaatgatcaataaaaagttttattagtattaacttctaataaaaggactggtttgtcaagcaataacatcttgtcttttgaaaaaaattaaaaagcgctccgcccgaagttaacgtgatttctgttcgacgatctccagaatttttcctgcgacttcggcaatgctgagtgacgtcgtatcgatttcaatcgcgtcttccgctttgcgcagcggggaaacttccctctctgaatcgagtttgtcgcgtctggcaatttcttcaatgagcgtctcgtaattcacgtcatagccttttttcttattctcttcatatcggcgcttcgctctttcctctacggacgcgagcagaaaaattttcacttcggcatcaggcagcacgtgagtaccgatatcacggccgtccatgacgacaccgcctttttgtccgagctgctgctgtcttttgaccatttcttctctgacgcctttatgcttggcggcgatggatacttggttgctgacttcgtcttttcggatttcttctgtcacatcttctccgtttacgagaacgatttgtctttccggagcggatacaagctcaatttccgtacgcttcaaaagctctgtaagcgcggcttcatcggttaaatcggcattctgcttgagtgccgtatatgtaatggcacgatacatcgcccctgtatcaatgtacacatatgattttttctcagctactattttagcaacggtgctttttccggcagcggccggcccgtcgatcgcaattgataatttcttgtccataatctctctccttgctctttactcctctatggattgtatcatgaactgccggaaaaggggcgaaaaaattgagctgatttaccgctttaccgtttcaatccattcttttttctccattttatcaactccctcatatttcacagctttcgaaatataaggttcaataggctgataatgaagcaaaaactgcaccgcgcccaaaattataagctgaatgcagaccaatttgaccagcagacgttcaaatgttttcatacacgcgcacctccattaggattagtatggaaaagtgcgctgctgtttattccgacagactgtttcttctctgctgcagctgcgcgcgcatacaatattggagtaaaagctgctgtgctgcggggccgatttctgtaaattcaagcgtcattttttgtttatccgccttttcatcataaaaaatccgctgggtaagagcctcggccgttatatccgccccattttccttgccgggaagagaaaatgagacatacagcttttcacctggttccgcggaaatatgctcaggcatcacaacagcgattccgccggcgctgatattagaggaaaccgtttgaaaagcggtttttttcgcttccaatttgacggatacatccaatactgcgtctgcacggacgtatcggcgtctttgaatccgcttcatttcctcctgagggggatgtccaatccgatcatcgggatgggttcttttttctttcctttaattatgcttttaaattgatacggtacttggccattccccataaattccgctgttatttccaatcctttatgcaaaaagaccgtccgtcccgaatccagatcgacgggatatgagatgtggagttcgccgttttcaacgcttactgctttactcctcgcttttttgggctcattgttctctatgtattcaatccaaatataatctccgacagctatcatggccttcactctttcattatttatgcttttattaaagcatgtaatgaaaaaaaggaaaagacttttagtcctttcctcctttatttttataggtctttatatataggctctgcgctttttaatttttctattttttcctcttttccgtcgtccgcattaatgaacatttgatacgtgtctttcccgatcgtcccgagcatttcgtagcaaagcacttcctgaccgagttcattcgtgatcagcgcctgccgggtctcccgcacttcaacatttttattcagcttcgctttcgcttcatcagctgacaaagcgggagccggaatcgttctcgtgcggtgcgccgccaggtaatcacgcgcggaaaaaccgacgacttcaccatcatccagcgccactttcattcggatggcttccggataaatgcggacgtttttctccacgggaataaaagaaaagacgccgatgttattatattgcgcgctttcatcaatttcgagaccttttgtttcatatccgtttttctttaaaaacgcgacagcccggttagatgcttcattgaggctgatcttttgtttcttcacggcccgtttttgaatcaaatagacaggatgtccccctttttgggtaatatccatatagataaaagatttgtgatccgcgtcattcatgcggatactgtatacatcgcgattcgtcttccggccgcttttgaccactttaatggaataattatgatcaggcgcaaaccgttgtgcgatttttaccgcttctttttccgtaatttgttttcctttcagatgcgtaaaaccttttcgttctgtatttgctcccgtaaatgtggggctgatgctgtcttcagaaaaagcgcctacatttttttcgactgttttaaagctgtcgacgatcgtattatcgctttgttttttgtcagaggcgagcgccatttcaacatccatccaccgtaaatttttgctcatgacgagatgctgaacgctgcgaagctggttttgaatgttctccgcctgtttgtacaggctgttcagtgttgtatattctttcttatcaagcggtttttggtctaaatcccggacggatgttttatagctgaaatctcctatattggataaaaactcctccgtcttattaaaaggcatgagagtcaggggcagctggctcacattgttatgcgcttcagatgtaattctccatacatcaatgagcgccggagacagagattttttactgttcatcgcaagcgtcgtcccgattttgtcgtgaagctgatcaacatggtacgtcagttcatgaaaagccctctgataattattttccgcgtgcagaaggaccgcatctttttcctgatgctctttatatccccagtatccggttgcggcgatcgcgacaccgagaacagcgataatgattcctctaatcatgttaacacctcattttgcgtacttttactcacagaaaatgtgctttccgattcttttaatctgcggacgtccccaaatccatttgcttgtcgccgtatcaggattgaaataataaagcgcgttttcagaagggtcccatccgttaatcgcatcaagaaccgcttcttttgctctttcattcggctgcatgtatatttggccgtcggcaacggcggtaaacgcgagcggttcgaaaatgacgccggccaccgtattcggaaataacgggcttttaatacggtttaaaataaccgcggcaatggcaacctgtccttcaaacggctcaccgcgcgcttccccgtacacagcctgcgccagaagattgatgtcgttgtttgagaaaccgccaggcatattagccgctgtcgtattttgcttttgatttgactgaccgcctgtattgttttgcggcttttgagcaggcttattcgtttccgcaggcttctgcgctccggctctcggttttgtttggttttccaatgggacgttgccataatgagtgaacgtattccctttttggatctgctccattacatattcacggtaatattttgattttgaaatcagcacctgtttggttttcgccccgacgaggccgtcaaccggcttcatgccgaatttctcctgaaaatttctcacggcccagtatgtggtccagccgtaaacaccatcgattttcccgttataaaatccgttatattgaagacgggcctgcaattctataacatcatcacccgtcgcgcctctttgaatcacttgatttgaaaacgcatgaaccgtttcatgatgatcgaagaaagcggcggcgaaagaaaatagaatgagacatgccataaaggctcctttgcacttcatctcttcaagcctcctactgcaaaatttaaagtgtacccgtattgtctgtcacgcggatatttttatacaccgtttccttcttatccctcatcaaggcataaaaaaagaaaccgcacgcgatgcgcggtttcttcacacttggatcatattgacggagcgtgctttttttgcctttcgcagcccgaaccaccataaaaacagcataaacggcagcatataatatacccaatgattgagggcggtaagaataaaatcgtaagaaccgtgcagacatgaaggcacggccagcgaaatcacaagccatttgacacgggcttttttctgcgaaaagcgggcttttccgagataaaatcccataatcactccgatcagcgcatggcaggagaccggcagaagcgctcttataaaagcatgctcaacgccgtggccgaataaatacagaatattttcaagcgtggcaaagcctaaagacacactggccccgtaaacgattccgtcataatgctcatcaaaatgagcatgcgggtacacactgatcatcagaacgaaccatttcaccgattcttccaaaaatcccgaagacaaaaacgaaacgaaaaagcttcctccccccacatgctctttttcaagaacatattggataaacatggtcggaaacacaaggacaaccccgagaaaaaaagacctcagcaccatatgtacaggttcattgtcatactgatcttttaaataaaaatagcttaacagcgcaatgccgggagcaattcctgcagagatgattgcaaacatcaggcaacctctttcctttatattcctatatctatggtaccatgttgttcatatttttacatctttcaattttttaaaaaagagcatatgaatgatcatatgctctctgcacccagccgttttgatatttcgtttgcgatcaagccgccgtgaaaacggccgttctcgataaaaatttcattggcgttatttccagccgcaatgactccggcgataaaaacaccgtcaacatttgtttccatcgtttcttcccggaaaaacggccggcctgattcagcatcaatctgcacaccgattttttcgaggaaaccgtgatcgggatggtatcccgtcatggcaaatacgaaatcgtttttcagccggaccgtctcatttcggccggagcggaaaatgatttcatcttccgtcacttcttcaagacaagcgccgaattccatccggattgtgccgtttctgacaagggcctcaaactcaggcagaatccacggcttgatgctcggggaatactcatgtcctctgtagagcaccgtgacgcgcgcaccggacttcacgagttccaaagccgcgtccacacttgagtttttcccgccgatcacagcaacatctttatcaaaataaggatggccttctttaaagtaatgaaataccttaggaagcccttcacccggtatgttcatataattcggatgatcataatatcctgtcgcaatgatacaaaacggagtgaggtagcggtcttttgacgtttctacaagaaaacggccgtcttcctgtttcgttacgcgctccaccgtttcaaaggcgtttacgcgcagctcttttcttctgacaacctctctgtagtaagagagagcctgtattcggaccggttttctgttttccgtaataaaggcgacatcgccgatctccaatttttcacttgaactgaaaaaagtttggtgcgtcggatagttataaatgctgtttacgacattccctttttcgatcacaagcgcgttcacgccaatttgcttcagatgtatagccgccgataatccgcaaggacctccgcctattataattgctttttcttctgtcatgtccttcaactcctgcgattggcatttccatcataagtttccactcatataaaaaatctcctatattatcataggagattttttttgtttatgcaaacgattggtttatatccagcctctgaaacgcgaagcctcagccattttccgcacgccgaccatgtaagccgcaagcctcatgtcaatccggcggttttgggacatttcataaatattattaaacgattttatcatcatattttccagtttttcctcgacttcttcttcactccagtagaagccctggttgttttgaacccattcgaaataagaaaccgttacaccgccggcgctcgccagaacatcgggaaccagcagcgttcctttgtctgtcaggattttcgttccttccagtgtcgtcggtccgtttgccgcttctaccacgattttcgctttgatgcggtcagcgttttcttctgtaatttggttttcgatcgccgccgggacaagtatatcacagtccagctcaagcagctcctgattcgtaatggtgtcattgaaaagcttcgtcaccgttccgaagctgtctctgcggtcaagcagataatcaatatcaagaccgtccggatcgtaaaggcctccgtacgcgtcagaaattccgacaactttcgcgccggcgtcatgcataaacttggccagatagctgcccgcatttccgaaaccttgtacgacgacacgcgcgttctgaatatcgagaccttttttcttagccgcttcttttatgcagatggtgacgccttttgccgtcgctgattccctgccgtgggatccgccgagtacaagcggttttcccgtaataaagccgggtgagttaaattcatcaattcttgaatattcatccatcatccaagccataatctgtgagtttgtaaatacgtcaggtgccgggacgtctttagtcggtccgacaatctgactgattgctcttacatatcccctgctcagcctttcaagctctctgaatgacatatttctcggatcacaaacaattccgcctttaccaccgccataaggaagatcaataattccgcattttaaactcatccagatggaaagtgctttcacctctttttcagttacattcgggtgaaaacgaatgccgccttttgtcggacctacggaatcattgtgctgcgcacgatagcctgtaaatattttcacagacccgtcatccatccgaacaggaattttaaccgttaataatctgagcggctctttcagcagttcatacacttcttctggataccccaatttttccagagctttatgtattacggtttgggttgattttaatacatcatgtttgtcttcttcattatgaccggtgaatcgatcggctgccatttgagttaacctcctaaaatcttctgtttctctcatgctccctttcagtgactagtatacaccttcaatatctccgtgcatagaagaaagacaatgatttttccattatttcgcttaaaaaaagacggccgctgaaaacagctgccgtttcaaatcttttttatgaaaaatgtttctggatggtttccacagcattgccgtccatgatgagttttccgtactcatggagcctgtaaatcgtaattgtcgccgggtgtccgtattcagccagcaccgcgatgacaccttcggcggaacgggagccgaggtcttcaaggcttacatagtattggttctcataatggtagacggtgccgccggtaatcccgatgcggtgaaggcttccggcaagctgaatgatatcttcaaacgaatggaactgataaataatatccgggctttcgtcaagtttgacctgcatctcgatataatcatcgtcatattcgtcatcttctgcgtccgcgtcatgatttttcgttacaatcacaaccataccttgtgcctgaagagaatatacttccaccgcgatcggaccattcgcttcaaagccgagctctgtatttgcttcattcatcatatctttaaataactggtggactttaaacgagtccttccagaggtcttcttttgtcagtccccgatcagtcagatcgtcgagggttaaaaagattttaatcttattatagttcagacgctcaagccgcataatgttccctcctgcctcttcttgcacacaaatcatataacacagtatatgaataaatgagtcataggttcttaatttgttatcagtttacaccgtgtacagcgggaagacaagcagaatgccgttttttatcaccgcggccggatttgtttcaggaaaacggctcatccggcccgcacagcgtaatcatatgcgtctccggcttcgccccgagcctcagcggaacttttgtcgtcccgtagccgttgctgatcagataatgcgctttttttaccgttcccgccccgcccaattcgtacggcccgaaccggccgaaacggatttggccgccatgcgtatggccgctgaacacagcgtcaatcccgtctgactccctcatctgctcatggatgtcggggttatggcaaagcagaaggtttactttatcagcatccgtatatctgattgcagcttcgtaatcatccatcatcatcctgatatcatccaccccgcagatcgtaacggtttcccctttataagcaaactgaaccgattcatttctcagcggaatcactttgtatgcccgtaaaagtgagagcaatttttgctggctgacctcgtaatcattatttccccacacataaatgacaggcgcgagagccgtcagacgtttgatgttttcttcaattctggcgtaaggaactccgccctccgccaaatcaccgccgagcaaaacggcatccggcttataaactgccgcttcgcggagaagcttttcatcaattaaacggcggtgcacgtcagatataaagaagatggtgagcggcttcatccctttcattttatcaagcgtaaatgtatgtgttttcagatggctgccgtttgccgttttgtacatgacggccgccataaccgcagccgctcccgccaatgagccgagaattcccgctgttagcttcataaacgcactctccattctgtcattgtcttacattagacggacaaacaaaaaaagacgtttctatcctttccggaaaacgcctcattttatttgctttcaaaataaagattgatatcataccgatgtttcatcaagtgaaaaacagattctctcgccctccatttttcaggctggggccataaatccgtgcttttttggataatttcacatctcagtttatgaaattcaccctcagctttttcttccttttttttaaaataataagaagtgcaatacgcaaaagcggaagccataatccagcacaaataaaccgtatggcctaatatttcctgcagaatcagctgcggagaggcttgggggcattaaagcttttaaacatcagcagtatgcacatcagggaaaaacaaacgagggacgcccactgccatcttcggcattgtgcggcataattttcgtattttaatttccgtttcaccagcgcctgaagcatttgtttcgtcggtccgtcagcaaatcggtctaattgcttccataaagaatccatgcgcttcacaccttgtccgttttcattagtacactatatgaaaaacgcggtgaaaacatgcatttattttaatcagacagcggaatgttcagaacctggccggtgtacacgtcgtttccgtttaatccgttgtagctgcggattttttcttcgcccgcccggcttttataatatttcattgaaatgcggtaaagcgtttctttcggctgtacagtatgctgtacggtccgcacttttttcgggacagtcccagcttgatcacttgcggcagccggagccgctttttcacggacagccggcggagactgctgttttgtctccgcgtattcggtgtctgtcggctttacttgtttttctgaggacgtttccgttttttcaggtgttttttcacttggtttttcttttgttttttcagatgcagccgcttctttcttatctttgtcgtcagacttttttttcggttgttctaaaagagcggtttctgacgtatctttctgagcgcctttcggaataacggcaggcgcgctttcactgtggtctatgaagacatcttcatagtccttcgggtcaaatctgctgctgttcgtcatataaagaagaccgaaaaagacaccgattgttacgataatgaacaggacggtcagaaaagtgaacagcggcgtttttgttttggttttttccttcacctgctcttccttttttttacgctcctcttttacagattgtcttgtcgggaggctgtcttcaagatattcaatttgttcatccgcggccgcggcaacctgctgctcggcacgctgctgagcttttcttctttcaactcttgacatttccgtcatgcaaacccctcctaacatattgaaaacggatctgacaggcaaataccgcatcaataataaaatgcgctgtaaccggaacgaataaattgccggtccattcatagataagccccagcaaaagactgatgcccgcaaccatcataaacagaagccacttcgccaagtatctgaaatgaagcacggtaaaaatgaagctggcggcccataagccgatatgtgtctgcagaacgcctctgaacaaaatctcttcgctgaacgaaatgagaagcgtcaaaaacaaaatgtgcagaaccggcctgttcttaaaaagcaatacattaatgccgccgtcatcatataaatgcgaaggacaccatttcatcaccgccagatcggcaaaaatgacaaggacggcaagagttacaccgtaccatatgatattatcgtcacgtatatgccacagctttaaaaaatcgtgaatgtcggtgaaaaagaaaaagccgataacagctgaaaccgccaatatgagcaattgggtggcatacagctgtatcacaatctcccggtctgagagctgctggatcaattcgctttgccgtctcagctgaactcacccgcagactctgaaccgaaaatccggcctaattccagcttccaatcttcaaaccgttccatgtttttccgttctcctttttgctcgtacggagccagatcaagtccgcagctgctgcagcattgtccggtttggccttcaggctcatacgattcatcaaaataagacagcagcgcttttcttatacattctttccgctctaataacgccgaaaaacggttcattttacgcagcttcttttccacgcggtatgtcagttcttcctgcagctgctcttttgtggtttttccttgcagatacagatggacggccgttcgcgcctgtgtttcctggacgcctttattgatcagaacgtcccgaagctttcgctcatcatccgtaccggcatcccgtatgacggccaaaatgccttccagatcataatcagacaggctttctgtctgaataatctgctgctgaagctcggtatcgccgggcgccctcagcaaaatactgacactcgggctgccgtcgcgtcccgctctgccgatttcctgcataaagccctcagccgtttggggaggataaaagtgaatgacaaagcggatatctgacttatccacacccatgccgaacgcattggtacagcagatgcaatcaagctggttatggataaattgctgctggatcaagattctgtcccctgtatccattccgccgtgataataatccgtccgctttcccgttttttcattcagctcagccgcaagctcttccgcccattttctggtcggacaatatatgataccggggccttcaagcttttcggcaagctccgtgagcctgtttattttttcggcattatcagccaaatgttctgccgccaggagaatattcggccggttgactgaataaagatgacgcaccgcatgctcaagtccgagcacatccgtcacgtctctgagcgtttcttttgtcgctgttgcagtcagcgccaatacaggcggctttccgagtgcctgtctgaaaggcccgagcttcgaataatcaggcctgaaatcatgtccccattccgatatgcaatgagcctcatcaataacaaataaactgaccggaacgtttttcaaacggttcagtacataaggtgaagaaagggcttcaggagacatatagagaaatttataccggctgatgttgctgagaataaaatgccgctctgcggaattcagcatgctgtttaatgccgcaacccgcttttctccttttgctttcagctgctgcacctgatcttccattaatgaaagaagcggtgaaataatcagcaccagcccgtccatcatgtaacccgggagctgatagcataatgatttcccccgccggtcggaagcatggcgatcgtatcctttttttggagcacgctagtcataatctcttcctgcccttttttaaaggaatgcaaaccaaaatatctggataaagctttatgcagctcagtcatgctgattcaccgtctttgccagcgccagcctgatctggaaatagctgaagcgcatctgcattccttcgcgaatccgtttaattttatttgtttgatgctgttttgcaaatgccgttatcatacgctgttcctcttcagaaagatactgttctataaaaaatgcaggctgatgcaatgatatttctacgatatgatcttcgattgtggcggtttttaaatttctgaccgcggcgatccgttcaatcggaaaccctttttccaacagctcaaaggtttttctggcagactgtgtcagcgcgctttccgcctgcagatcggacaacagctcgcgcagagcgggatatgcacattgcggaagcgattgaataacataatgtaccgctccccaaaactggacggacacataccattcatcttcgttcagctggagagcgagctgcttattcgttttgccgattctgttgaatgaagttaaagaatagacaaaaataagcgcctgccgttcacttacgccttgcagaagctgaaacagcgcgtcatgcatttggacggaaagctctttagcatctctgtttttccgcatgaaccatttgacccatctcagcgtctgcacatcgttggtaaccgggatatattgactgcattgatgctctttgtttgacaggacttgaatgagcagggaaagccgcctccacaggatgacggcaggcgtttgataatttgcgccgtggcagtgcttcggccaaggccgctcagcaaacgcccgttcaagcctttgaacgccgcgcgcagtcactttccgcgttccctcttcttttccggctgtgatgtatgagttctcggtgagtctatgcatagaagccgcaatatcgccgcgttcacactgtgaagccatgccgaaatatttagcgatctgaaataagccggcatcctgaatggtttgagacgacttttttccttttaataaatgaaacacagcactcggagtccgttcgccgtctattttgtccagacagtcgagaaccacggtatcaaagtagtttatcgccaatctaaacacacctacatttcttttgtgacaagtttcgttttttggttctttttattttaacagattttcatataaatttgacgtttaaagtcatcttttagggggaagtgctaaagagaatcccttatgtgataagcattctcaatcatttttctgttgaaatttgacactaacatcattacaataagtaagaggaataggtgttatatttaaaaatatataaggtaaaccatttgttccaacacgaacaatctgggaggttttattcatggcaaagtacacaattgtagataaagatacgtgtattgcatgcggcgcctgcggagctgcggcaccagacatttatgattatgatgatgaaggcattgcgttcgttacgcttgacgaaaataaaggtgtcgtcgaagttccggaagttctggaagaagatatgattgacgcatttgaaggatgccctactgattcaatcaaagttgcggatgaaccgttcgaaggcgacccgctgaaatacgaataaaaaagccctccccgtgagaggagctttttcgtcctgaataagactccggctgttatcggccggagtcttatttttttgccgatcagcacaaacaaaaaaagcgtccggctgttcttcacagagcggacgctttaagcctttattgtgtttggatgctgcgtttttgttcaatccaaggtttcagcttcgtaaagatgaacgtaaagacgatggtgatgataatgccttttacaatgttaaacggcagaattcctgcgacaaccgccgttttcaactggctgtttgacaatgccggtgaatgtaaaaaccaagtatacgcgggcaggataagaatatagttcaaaatactcatcagcacggtcatcgccgcggttccggccagcaggctcactgcaagcccttttgcagaattgagctttttaaacataaacgccgtcggcagaataaacagcgtccccgcgataaaattggctgcctgcccgacaggcacgccggccatgcttccttgaatgatatactgcagaatatttttaatcgcttcaaccgcaatccccgccgcaggcccgtaaaccaaaatagcgataattgcaggaacgtcactgaaatcaattttcaagtaatccggcagccccggaaacgggaaatttaacagcataagcacaaacgcaatactgctaagcatactgatgacaactaatttttttactttcacaatgctctctccttttcgatcaaatctctcgaaaagaggaaaggttcttttgcgccccaataaaaaaaccgcttttgttaaaaagcgggagcttactaaggcttggcaaagaaacgtttgatataagcatcaaaacgtctgctgaacctccatcttctcccatccagactatactgtcggctccggaatctcaccggatcctgccgccgaagcagctcgcgggcttagagcgtgacgctcatcaccgccggtagggaatttcaccctgccccgaagattgatcttatgaatttattcacattatatatgatcaaattgtaattgtatagagaactgctcaaatttaaataaaatattggggaagcccaatttcagctgattcagcggtttccttttctcctttactgcgtcaatacacattgacactctattgagaatatgataaattatcagatatttagtcagctaaactaggaggaaatctaacaatgtttcgagttttggtctcagataagatgagcaatgacggcttaaagccgctgatggaatcagactttatagaaattgttcaaaaaaacgtcgcggatgcagaagatgaattacatacctttgatgccctgttagtccgcagtgccacaaaagtaaccgaagaattgtttaaaaagatgacttctttaaaaatcgtcggcagagccggtgtcggcgtagacaacatcgacattgatgaggccacaaaacatggagttatcgtgataaacgcgccgaatggaaacaccatttcaacggcagagcatacattcgcgatgatttcttcattaatgagacacatcccgcaagccaatatctcagtaaaatcaagagaatggaaccggacggcttttgtcggggcggagctctacggaaagactttaggcattgtcggtctgggccggatcggaagcgagattgcccagcgcgccagagcgttcggtatgacagttcatgtattcgatcctttcttaaccgaagagagagccggcaaaatcggcgtaaacagccggacattcgaagaagtgcttgaaagcgcggatatcattaccgtccacacgcctttaacaaaggaaacaaaaggattgcttaacagagaaaccattgccaaaacgaaaaaaggcgtccgtcttatcaactgcgcaagaggcggcattattgatgaagcggcgcttttggaagcgctggaaagcggccatgtcgcaggcgctgcccttgatgtgtttgaagtggaaccgccagttgaatcaaagcttcccgaccatccgctggtgatcgccacacctcacttaggcgcttcaacgaaagaagcacagctgaatgtcgcggcacaggtttctgaagaagtgctgcagtttgcaaaaggtctgcctgtcatgtcagcgatcaacctgcctgcgatgacgaaagatgaattcaaaaaaatccagccttatcaccaaattgccgataaaatcggaagtctcgtatcacaatgtatgaaggaacccgtcaaagatgttgcgattcaatatgaaggcaccatcgccaaacttgaaacatcatttattacaaaaagcctgctgtccggtttcttaaaaccgcgtgtagactcaacggtcaatgaagtaaacgcgggcggtgtagcaaaagaacgcggtatcagcttcagcgagaagatttcctccaatgaatcaggatatgataactgcatcagcgtaaaagtaaccggagaccggagcacatttacgttaacggctacgtatatccctcacttcggtgaacgaatcgttgaactgaacggctttaatattgacttaaatcctgccggccacctcgtttatatccagcaccaggatacgactggtgtaatcggacgcgtcggacgcatcctcggcgataacgatatcaatatcgctaccatgcaggtgggccgtaaagaaaaaggcggagaagccattatgatgctttcttttgataaacatttagatgataaagtcgtcaatgagctgacttcggttcaggatattgtttccgttaaactgattgaccttccgtaaccaacagaaaacccaaaacattcatatgttttgggtttttttacgtttaatgggtcggaagcggattaggcgcggcaggcacagcaatcggttttgtcacatcataattaccgattttctttgcgtgcgcatgtgtgaacagcacctcagaataaccgaattccttcgcggttaacaaaagcccttcgatcattaaaatgccttccagcgaatcttcaactttatgtttttcggacaattggatccgcagctgctcgccgtcttccctttccgataccgatgcaatcgcatctgcttctataatgctcgcggtctgtgagcctccgtctgttgtcttcatcccgtcaatagcctgatatactgaataataggtttgttcagacgggatgagatactcttgtcccagactgtcgctgtaagaaaaatacgcccggtttgtctgtttatgtacggacatctcagcggaaatgccgtaagatttataaaaatcctgtccgtctccgttttgaacctttttcaatttaatccgctcgtaaggactccatgtcaaagtctctttcagcatctttttcaataaatcagaatcggcagctgattcgatagaaagacgtccgtttacctgcacaagcaaatccttcttatccgccgttacctgcacaccgtccaaaaggttcggcacagagaggaaagattcgggcacttctaagtttcctgcatcagataatgcctctgaaaccgattcgtcaggcttctttttttcaaaactgaccggaatgacggcggatgtatctgaatcggcaaacgccaaagtaatgtaattgtttttgttttcgttagaaacgacaaacgtcttctgatccggcttgacagcagctgactgactggctttttcagcttgaccgctgtcagctgtaagatcaccggcagatttgtttgtcatcaggtgaggagaaataatcagagcgatgcacaatgcgcagatgccggctgcagcggggccgatccagcttcgggccggttttttcctgtacggtttacccgtttcaatattccggtaaatggcctcgggtgaacgatgatctctaaccgccggaagttgtcttaacaactcctctactctttcttcgttccaatatgacttcatcatccattagctcctccctcaaaagctccatctgtttccgaagtattttgagccctctgtgttgggtcgttttgactttgctttccgagaagcggagagcggcggctgtttcctgaatggaatatccctgaataaatctcaagataataacagctctttgatcaatggtgcaatgatcaagcgcggtataaatttcccggacattttcatgctgtacggcgagttcgtccggaagcaaatgctgatctctgacatcttgtgtatcccaatcaaacgtacccataatacgctgtctgatcgtctgctgcttgcggaaccagtcaatcgccacatggcgtgcgatggacaacagccatgttttttcactgcttcttccttcaaatgtatgataggaattcaagacgcggatatacacttcctgcgtcaaatcttcagcctgcgacttatcttttaccatataaaataaaaattgatataaatcttgatggtatgcatcgtataatatctgaaaggtttcttccatgggaaacccctccgttcacttttttgtcgtaaaaatgcgttgaaaagttacattacaactatattacgagaaactggaatttggaagggaatttatattaacatattcttaaatttttaaaggagaaaaaaacaaaaaacacccgcatgttctgcgggtgtttcgtatggaacaagattgttcgtcaatttcagacgtcatcctgcgcttttgtcggaatataaaatgtaaacgtcgtccctttgtcgatgctgctgtgaaccgcaattgagccgccgtgggcttccacgatattttttacgatggcgagtccgagtccggtccctgccctgcctcttgttcttgctttgtccgctttataaaaacgttcaaaaataaaaggcaggtcctcttccggtattcccgagccggaatctttgatatcgattttcagtccgtcttttacggtatgagccgcgatatgaacgtttccgcctgactccgtatggcgcagcgcattatctataaggttggtaaacacctgttccattttgtcttcgtcaaagacacactccggctgagacaccgagatgtcctctgtgagcgaaacgcctttttccttcgctacaccggaaaatttgcgggagatcttctccagaaattcatgcaggtttaccgtttcatagcgcagacccgtatgtccggattccattctggccaaatccagtaaatcattgacgagccggcccatacgaagagattcatcataaatgatctgcgcgatttcttttttctcctcttcggtgcttgcaatgtcgtccactatcgcttcactgtatccttgcagcatagaaatcggggttctgagctcatgactgacattggcaatgaagtcttcacgcaatttatccagcctgcgctcttcggtcatatcacggagcacggccacggcgccgcggacgtgtgattccgcataaagaggcgacatcaataaaacccatgaccttccttgaagcgtcatttcaatcatttgctctttttccgtgttcactgcattttgaaacagctcttttgcttcagggggaaggttgtctccttctttaatgttcatgttctgctcataataccatgcctgcagaaaacgttcggccggcgggttggtcaccaaaatggtgccgtcgatattaatggtgatgaccccgtctgccatactgcttaaaatattggacagctgttctttttcctgattcagcgcgttaatatggaaattgagctgccgtcccatctgattaaaggcaatggccagttccccgatttcatcttgggtcagaatcggaatttttgtatcaaactttcctttcgccaagtcttgggcgccttcccgcattttccgaaggggatatgtcaccctgctggataaaaagaatgcgaaaaacgttgtcaagacgatggcaatgcccgccgcaagaaaaatatagcgtgtcgtatgtttcgtcgtatctttgacggcaagcagcgattgggataaaaagaccatgccttttttgccgtctttttcatagggcactccgacgatcagccgttcattatccgaaccggcatttttggggaccgcgcgtttgcttactttattgcggtctgtcagcgccttgtgcagatcccggtcatgtttaatctgctctaatgtaatagaggataaatgattatcgtcattgggcgaataccagacatgcttatcatcctgaatgatcgcgatgctcgttaaattgtccgccagttcccacgtgatggatctggcaagcggctggtcttcatgattttctattatgaccgcaattttatcggcaagctgcgttaaatctttttccgcttcttcaacgtggtaattttctataaattccagaagcagcaccgttaaaataaataaaacaattaacacgagtgaaagaatggtaaaccaaagctttcctactacgcttttccaaaacttcattcagcgcctacctcaaatttgtatccgactccccagacggtgacgatttttttcgccgctcccggagacactttgtttaatttttcacggagccgtttgacatgagtgtccaccgttctgaggtctccgaaaaattcatactgccacacttcttttaaaagcttttccctgtcgtacactttgtccggtgttttcgccaggaagtacagcagttcatattccttcggcgtcaggctcacctccgtgccgtccgcagtcaccctgtgagcatcatgatcaatggatagatgcgagaagacgagtacattttttgtcggggtattggctgtcagataagatgtttgggaagcccttcttaaaagcgcctttacccgaagcaccacttctctcgggctgaaaggcttgacgatataatcgtccgtacccgcttcaaacccttggacgcggttggcttcttccccttttgccgtcagcatgataatcggggtcgcttttttttctctgagctgccggcatacttctattccgtccgttcccggcatcattaaatccaagagcaccagatcataatctgatgccagccccattttaatggcctcgtctccgttttccgcttcttcaatcacatagttttcccgttcaaggtacattcttaaaaggcgtcgaattctggcttcatcatctactactaatattttagtttcatttgtttgatccatcgttttccccctgctttccttctgttactttcattttaacaaactgtgcggcagcttgagaactgtatcggctttttgcatctatgcgtacgaatgaagtccggcaagcacgagattcacaaaaattaagttaaacataataatggcgaagccgatgacggcaagccacgcggacttttcgccatgccagcctcttgacagccgcaagtgcaaatacgctgcgtaaaataaaaaggtgatcagcgcccatacttccttcgggtcccagccccaaaaacgcgtccatgcaagctgcgcccaaatcatcgcaaacacaagcgcgccgagtgtgaataccggaaaaccgatggaaacagcgcggtagccgacttcatcgaccaagtccagattcacatttttgacgagcgggcttataagagcgctgattctctttctgaatatcagcctgagcgccccgaataaaacgagacctgcgccaaacgaccagatcaccgtattgacctttctgcctgaaaaaatggccggaagctcaataagcggcttcattgcgccttccgtaagcagttctccgtcatgcgggccgacaagcgcaggcatatcatatatcatcacgcttttagcctcttttttatccacccaattaaattctgctttgtagtccgccagccggaatgccgacgtgacggcgataaatgccacggtcgtcacgagtataaacatgatgacttcaagccagaacgtttttttgcccggtctggattggtcgacatgctttaacaggaaaatgacgccggctacaaaactgatcgcaagaatcgcctgcccgagcgccgcagtcgtgacgtgaatgtacagccaattgctctgcagtgacggaataagcggcgtgatgtctgtcggaaacatgcttgcatatgcgataagcaaaagcgcgatagacaatgtgaacatgcctaatgaaggcagtctgtaaataaagtaaataataataaaagcgagaacaagcatcatgccgaatgacgtcgtaaattcaaacatattgctgacaggcgcatgtccgcttgccgaccatctcgcaataaagtagccgaggtgacaaagaaatccgaaaatggttaacgtgattccgatagccgaccagcggcccttaccgtccttcgcaccttttgttccccggatggcgccgccgaaaaccgggacggcaattaaataaatcaaaaaggcagcataaagaaaatttgcgctcagctccgccatgacaccactcctttttcactaggcctgatttttggccaattctttttgatcggccggctcttgaatcccggtcccgctaagaacaaattcgatatcctttttcagaccgaaccagtttttgttcgtatgtcccgccacaagcacttcatgatcacctgttttgatccagatccttctgtgctgccagtacatcccttgaatgacgccgatcataaagatcgcgccgccgacggcaagcacccataaggttaagtcttttctgacggtgagtcctgtaatgtttttcgtttccacatggtcgaattttaatttgtacttgttactttcggaaccttcaacagtctgctgaatcgcaacaaaacttttctcccctttcggcttgtcgggagccgtgattttaaagacaaaagccggattgttaggaaccttcgtcttcgtgctcggttctccgtctttgttaaaataaaaatcaggaagataactggcaatctgcactttgtaaccgttaccaagatcgtagtccgtgtcgggatcaagaagattgatcttcagtttgccgaatgactgttttgttttttggtcgatcagctgaaataccatctgatcgagctggttttctttatagtccacctgatacacagaataggagtcaaagcgcagcggttcattgacgcggatattgttttctttgactcttttaagcttcggcttttcaccgaatacaatgtcgccttccctcttgtacagaaccgcgtccgttgtgaaggatttggcgactttgccgtttccggctctgtcaatggcgtcggcgaatacttttttctcagtgtctttgttatatgtctgcatcgtgaaccggttgttttttaagtaatatttgccgtctgtaccggggatctgggcggtttcgccttcacggacccagagcgtttcatcgacatacataccgggtacaaatctcagcatggctccgatcagaaaaatgatcaggccgatatgattgacatagggtccccaccttgaaaaacggcctttttccgccaggatgcttccctcttgttctcgcactctataatgcttttttttcaatcgtgttctgaggctatcagccgcatccccgctcagctcggtttctgtccggctgtatagacgctgcctcttcaaaaagaccggattccgccgaactccttgatttttaagcgccctgtacaaaggaatcacccgatccaggctgcagatgaccagtgatatgccaatggatgcgatcaggagcatataccaccatgagccgtacaggtgatgaaaccccagcaaataatacagttggccgattatgccgtactgctgttcataatatgtatccggctgggcgcccggaggcagataagcttcctgcggaaaaaccgtgccgaaagcagacgccgccagagtaatgacgatcagccatattccgacttttacggaagaaaagaagttccataccttatctacgattgttttgttatatgtttgcgaacgccttgcgctgccgtcgtaccgcatatcggcaagcggcgatttttgatcatcaagcggcttcccgcacgactcgcacaaaaccgtcccggctggattcacgtgcccgcactcacatttgacctttttcatgaagacgcctccggcttaattaaattcatatagtcatgaaccatgcgttctgtcatcgtgccggtcaccactttcacgacctttccgtcgggattgatcaaaaatgtcgtcggaataggtgatacgccgtacgcgtccagcacttgccggtcagtatcgagcgcaaccgggaaattgacgccgtatgttttcataaaattatgtactgcaatttttgattcgccgacatttaccgcaaccacctcgacaccgaggtctttaaaatgcttgtattgattctccatgtagggaaattcctgcttgcacggctcacaccacgttccccagaaattcagaaaaacacctttcccttttaactgactcagttctatgagtctgccctctgtatctttcagcgcgaaattcggggctttggacccctcagatatacgctctccgtttgtgtaaacggcattatagatggtatatccgagcgcgcagagtaagatgagaaggatgccggtccgaatgaataaacgccgccgttttttgttcattgtacactgctcccctcccctgtctgcaaatccattcaattatatcatctacacgttttgtaatttttgaaggttatgtgaaaattagaaagcgtttttaccgtgttcagctaaagcccgcagccttttcacctcatgcggcgtcaattctcttgcgtctcctgtgcgcaggcctcttaaatctaaaaatgcgtattcttcacgtttgagtttcagcacgtcatgaccgatcgcctcaaacatgcggcggacctgtctgtttcggccttcatgaatcgtcagctgaataatgctcgtctgctttcttttgtccagggaaagcattttcgctctggccggcgccgtcttgccttcttcaagctgaatgccgcgctcaagctttctcagaagttccttggaaggaatccccttcactttggcgacgtacgtcttatcaatttcgtatttcggatgcatgagtttgttggcaaactcgccgtcatttgtcagcaataaaagtccgctcgtatcataatcaagcctgccgatcggataaatgcgctgcggcacttctttgaaaaagtcggtcaccactttccgccctttgtcgtcatcagctgctgagatcactcctctcggtttataaagcagaaagtacacgggttcttcccgctccacctttaatccgtttacttcaatctgatcagaaccggtcacttttacgccgagctctgttattacttttccattcacctttacttttccttcttttatcagctcttccgcctttctgcgtgatgccacgccggcatgagcaataactttttgcagtctttccatgtcgttcacctcaagtataatcttacttttttccccttgaacaaacaagctttttcaaggagagttattctgatatataaaaagcgcctgatttcaggcgcttccaaataataacgcaactatgatgattgatgcaaccaccccgatcagatcagcaagaagaccgacctttaaagcatcccccatttttttgatgccgaccgccccgaaatacaccgtcaggacatacagcgtcgtatcagtcgatccctgcatgaccgaggccagtctgccgataaatgaatcaggcccgtacacggcgatcagatctgtcgtcatgccgagcgccgccgtccccgaaatcgggcggatcagagcaagcggcacgacttctgcgggaatgccgagcgctgtaaagaaaggcttgcacagccccatgacaaaatccagcgcgcctgaggcccggaatacggtaatcgccaccagcatcccgaccaaatacggaatgatggaaaacgcaatctcaattccttcttttccgccttcaacgaatgattcatacgtcggcacttttttgatcgtgccgtatatcaatataccggcgataataatcggaatcatggctaaagacagccaattcaccatttccattcgcttacctcccttttcttttgcggcggtaccagaagtagcggtcaatgaaaatcgcgccgattcccgaaattaaagtcgctaagatggtcggcccgacgatatcggtcggtgatttcgccgaataagccatgcgcacggcaatgacggttgtcggtatcaatgtaatactcgaagtatttaccgccaaaaaggtaatcatggaacggctggcctcagacttacctccattcagctttttcatctgctccatggctttaatgccgagcggtgtcgccgcatttcccagtccgaaaaagtttgccatgagatttgataagatgtaccccatggccggatgatcagggggaatatcgggaaacagcttagagataaacgggcggcacattctgctgaatatatccaaaaggccggactgctcggctattttcatcaggccgagccagaagacgagcacgctcattaatccgaacgagatcgtaaccgcttcttttgctcctttaaaaacagcttcattcacatcctgcaaggtaccgttaaacatcgcaaagacaagtccgattaccgtcagacatacccagattaaattgaccatgacgaaccgcccgccgcgctcataaacaggctcgtaaacgtctcaatgaaatgctttttcggttttttatggcgctcgttttcataatagacgggaatcttggcgatcactttcccatcatgcataacagtcatccggccgacgacatcaggaatgagagaggcgtcctttttccaggcttttttcggttttattaaggttgtgcggatttttacatcgtcgatttcatcctcttttaataaatatttgacatcccgggcaataaaagcgtgttttccgtaaaacgtctttttcagcttcggaatgccgccttttttagcgacgacataggttttatagtgttcaaagacataattaaacatattcatatggtcatcccagtcatccggatcatttatggtgaccgcgatgagatccgttccgtcttttgaagccgtcgaaacgagcgtccgtttcgcgatttttgtgtaacccgtttttccgcctgtgctgtaacggtagagcccagtcagaagcttgtttttatttttccatacccggtccatcgtttccgccttatacacttttgtgcctgaaacggtccggtattccttgattttcattgcgtatttagtcaaaagcgccatgtcatacgccgttgaatataaattttcatggtcgtccagtccgtgcggattttgaaattttgtattttccatcccgatttgctcggcttttttgttcatcataaatacaaaaccgtcaaggcttccgccgacatattcagctattgccgcagcggcgtcatttcctgatctcagcataagcccgtatacaagatctttcagctttactttttgtcccggctgaagataaatggctgagccttccgtttttacagcattcggggaaaccgtcacggtctcttccatctttcctgattcaatcgccagcaccgccgtcatgattttcgtaatgcttgcaatccgccgcttatgatgttcatccttggcgaataacaccctgccagatgctccgtcgataataatcgcgctttttgcgctgacatgtatttgggcatgtgccgtattgccgtctgtaatggaaaaaagaataacaaaagtcaaaagaaatacggcagcttttttgagaaagcgcatgaatgctcacgtccttgttgtgggtttgtacaagtttatgcgcctgtccatgacttatgaataccaattgcatcactttcacataaaaaaactctcccaaaaggaagagtttttatctgactgatgccatatttgagcctgatgcttcatattgcgccaattcttcccgcatccgcagaaattcactgctgagcgaaagcagaaggctccgcagcgagtccggcacttgctggtagaactcaatcgcgctttggcctgtataagcggcgcggctgttttcgtaccatgtatccttttttggcatgaaaaattcttccacgcactgatgatacactttatacagcgttttttccgctctcacctcatgaaacggctcctgcattaagagccgccggcaggcttcctgggcgccttcgcaaaagacggtcatcctcctcagcacactgagcacgtcgcggcagtatgcctcatccgcctctccttgagcccgcatctccggcaatgttgtatgatttaaatagctgctgaccatcgtgacaacctcggctaaaaattcaccagtttcttcagtatgggccctcacaatcgaatttcccatttccgtccgtttccttcctctcttgtacgtcgtcatttgcgtcattcatcaatggcctttccctactatcgtatgatgaaaaacgattattatttaatatcctcaaaagtttggttgaagttttcaaagaataaatcggcttcctcctggagaacgtcttcctccgcattttcaggaagcggcgggagctcctccaatgtttttaagccgaattgttcaagaaataccggtgtcgtgccgtataaaatcgcccggccgggaccgtcggcgcggcccacctcacacagcagcgcttttgacacgaggctgtgcagaatccgctcagacttcacgccccggatatcttcaatttccgcccgtgtgatcggctgcttgtacgaaacgatcgccagcacttccaaagaagcctgcgacagcccttttgacggcacttcgattagttttttcaaataaggcacgaattcttttttcgttccaagcatatacgtatccgcatattcggtaagctcgatgcctctgtcgtcttccttgtactgagcggccacttcttccatgattccggccagttccgcttcttctatttcaagcaccgtcaccaattgctttttggtcagtccttcatcacccgccgcatacagcagggcttccacaatcgctttccaattcacgatatcaaacgccatgaatggattcactccccgtaatgtatatatctgaaaagttttcttcctgttcaatgataatctgctgatttttcatcagttccaggactgctaaaaacgtcacgacgagatggtccctttgccgagaaggaaaaagctccgtgaagtttattcttctccccgccgtttttaagctttttacgatttctttcattctgtcttcaatcggtatttcctgtcttgtaatggtcgtttctttcggccgcgtgatttttttacgctgaagcaccttttgaaacgcgccgatcatgtcataaacggtcaccgacagtttctgctcggtctgtttgatttcttttgcatactcacttaaatcactcggcggctttgtaaatgacttttgtctttcttcttcccgctcttttaaatccttcgcagcggttttatactttctatactcaatcagcttttcaatcagctcgtcccgagggtcttcttcttcaagcatttcgtcttcaaacagctcttcttcttgtttcggaagcagcattctgcttttaatgctgagaagcgtcgccgccatgaccagatattcactggcgacatcaagttcaagctcttgcattgtatgtacatataataaatattgttcagtaatggttgccacgggtatgtcatatatgtcgatttcaagacggttaatcagatgaagcagcaggtccaatgggccttcaaacgtatcaattttcacttgatattctaccattatctcaccattttcagtatcactctcattgccggaaaaactggctaccctttagtataatccaccgaaatgctctcgtccaatacttttatacacgtcctccgttatttagaaaatactgaaaaagaagatatacgcctatacctttaaaggcggatgcacataggatagccgtgtaaacttgaaacaaagggaggctgatttcacatgagcggagcttgtttcggcggaggttttgcattaattgtcgttctgtttattttgctcgttgtcgtaggagcatcttacatctgctagttcctcaggcttcagacaccaagccgctcttttttccttttcaaagcgctgtggtacactggttttagcataaaaggaggaagcggcttgtatcctaaagcttatatcggctttttggccgaatttcacgcatcaagagattattttgaatgtcatgaactgttagaggaatattggaaagaaagcccggctgaaaagcggagcattcattgggtcggcctgattcagcttgccgtcgctctgtatcaccagcgcaggggaaatgaagccggggcgaaacggctgattgccaacagcttacgtattctccggtctgaaaagcaggcggtctgttctctcggtctcagccatccgaagctgattgagctgatagaaacgctgtcagacgatatagaagcgggcctgccttacagaagtgttatgcttccgattacagatgaagccctgaaagaagcatgtcttgccgaatgccgccgaaagggctatacatgggggcaagacggcgtatcagatacctttcttattcataaacaccgcctgcgggacaggacggatgtcattaaggaacgcgaacgggaaattgagagaagaaaaaaaagcagaggctgacggtcagccctgctttttctatatcaaaacagctcccgaaaccgtgaagattccgggagcatttgtcagttattatatgagatatcctgatctttttgatgttgacagcgttcaaaaaagctttgcgttaattcattcggaacgagtgcctccgttttgaacagacgttttaaggcgtccatcatttgctttccgattccttgatggcggtgagaaggattcacgctgatatgccggatttcaacctctgagtcctttttttcgactccgatcgctccgacgatatcttcatcctctttccaaagaaagagctggcggccagtatccgtttcatagtcctttattgtctgctgaagctgcttgagatctttttcattcggcataaatgacagaagacccatcgcaatcttttcaaacgattttttataacgaattaacataaaaacccctctatatccaaaatgtccattcatgtcctatcaaacggatacataaaggcgatccgttttctcacattatatcattttcgccgcggttttaaacgcttttcaacaaattattcaaatgaacggtttaaatttgccatttcaatggcagatactgcgcaatccgctcccttatttccggcttttgttccggctcgttcgatggcctgctcaatggtttcagtcgtcacgatgccgaagataaccgggacgcccgtcgccgttcccgcctgggcgatgccttttgccgcttcattgcagacatagtcataatgcgttgtcgctcctctgataaccgtgccgagcgtaatgacggcatcgtattttttcgtttccgccattttctttgccgcaaacgggatttcaaacgctcccggcacccaagcgacgtcaatgtcgtttgattctacaccgtggcgaagcagcgtgtcttccgctccgcttaacagcttgctcgttataaattcattaaatctgccgacgacgattccgattttaagtcctgttcctactaggtttccttgtatgatattcatatgttatccatccttttttgtgagatttgtttttagaaatgaagcagatgtccaagttttttcattttggtctgtaaatactgcttgttatgctcactcgcttccatttgaagcggcacccgttccgaaatgctgagaccgtatccttcgaggccggcgattttccgggggttattggttaaaagtttcatatgctgaacccctaagtcgcggagaatctgggcgccgatgccgtagttgcgcagatcaggcagaaagccgagcgcttcgttcgcttcaaccgtgtcgtacccttgttcctgcaatcggtacgccttcagcttattgattaaaccgattcctctgccttcctggcgcaaatacaatagaacgccgcggccttcttcagcaatttgcgcaagcgcggcatgaagctgaggtccgcaatcacagcgatgggatgcaaacacatcgcccgtcaggcattctgagtgcactctgacaagaacgggttcgctgttaaacgggacatcccccatgacaaaggcgagatgttcttttccgtcaacctcgtttgtatatccgtaaactctaaacgtgccgaagtcagtcggcagcgtaatatcaacttctctgttcacaagtgtcgtaatgttgtaacggtactctattaagtcttttatcgtaatcattttcagctggtgacgttcggcgatttcggctaactccggcactctggccattgtgccgtcttcattcataatttcacaaatgacgcccgctccctgagatccgcaggcttttgcaaggtcaacggctgcttccgtatggcccgcccgcttcaggacgcctcctttttttgcgattaaggggaaaatgtggcccggacgctgaaaatcgtcagacacagattcctcgttcaacagcgcctgaatggtaaaagaacgttcttgagcgctgatgcccgtttttgtcagcctgtggtcaatactgaccgtaaaggcggtctcatgtgagtccgtattatgatcgaccatcgggtgaagatccagccggccggcgatgtcttcagacagcggcgtgcagatcagacctctcccatgggtcgccataaaattcaccacttcaggcgtggcatgctcagccagcgctacgaaatctccttcgttttctctgtcttcatcatcgacaacaatgatgacttcaccttttttcagcgcctctaacgcctcttctatcggatgaaacatatcgatcttcctttctaaaagccgttctcgcttaaaaaggcttccgtgatagtttgattgcttttcgtttgttctgttttgtgcaaaaagcggtataagtatttgccgatcatgtcacactcaatatttacggtcgatccgactgttttcgtctgaaaaatcgtttctgagatggtatgcggaatgatggataccgtcacgctttcatctgatagaccgaaaatcgtcaggctcacgccgtctaccgtaattgaacctttcaatacgagcgtttttgtcaattccggcgaaagttttaaatcgtaatagaccgcgttgctttttttctcgatccgcgtaatttccgccgttccgtccacatgccctgatacaaagtggccgccgaaccgtccgttggcggacatcgctctttccaggtttactttactgccttttgacaagccgttcagcgaagtggatttcactgtttccggcatgacatcaaccgtaaattgattgtcagaaaatccggttacggtcaggcagatgccgtttaccgcaatgctgtcgccaagtttcacatcacttgtcacttttgaagcggcgatggttaatgccatggaaaggcctgtcttttcgattgcttggatcgtgcctgtttcttcaacgattcctgtaaacatcgtcaccatcctttccatctttaggtatggccgtcagttttatatccggcccgatttgggtgatttgtgtgaattgcaaatgggggacatctttcattgattgaaaaccttcaccggagatcaagctgggagcaagcgttcctccgattaatttaggggcgaaatagaaatgaagctcttggaaacagccttccttcacaaaacttccgtgtacggatgctccgccttccacataaacggacattattccgttttcagcgagaacactgagcacctcagggatgtgaatgcggtctgtttccagcggaaaaacttttattccgagtgcggtcagccggtctttcttttgcacgtctgcacctttggccgtaaatatccatgtcggcgcagcgccgtcagtgagcacatttgccgtttcaggaatggtcagctttgtatcgagaatcactctgaccggctgcttcaccgcatcaggaagcctgcaggtcaggctcggattatcggctttgactgtgcctgctccgacaagaatgctttgatgcgatttcctgtattgctgggcatcaagccttgccgcctctgatgtaatccatttgctgtcaccggtttcggtcgctgttttcccgtcaaggctcgcggccgctttcaaggtgacatacggaagtccggtccgcatgaagtgaagaaacattttattcagctcttctgcctgctgcctgagaaggccggttttcacttcgatgcccgctgcttccagcattccgatgccttttccggctacaagcggattcggatctttcacagcaatgaacaccctttttatccccgactttattatcagttcggcgcatggcggtgtttttccgtaatggctgcaaggctccagcgtcacatacaaatcggcgccttttgcgtgtctgccggccatattaatcgcgtgaacctcggcatgcgcttctccgtattgcaaatgggcgcccattccgacgatctgtccgtttttgacgacgacagcgccgacaagaggattggactgtgtctgtccttcaccgcgtctggcaagttctattgccgtattcatataatattcatccattgttatccctcccttcttccacgcaatttggcgtcaaaaaagccccgaatgtttacacagttcggggctttgccagttttaatccataggaaataagactatacagtaagtttattttttgcatagcttctctcatccttctcccatccagactttcactgtcggcttcagcttttcactgaatccaccgtatacagatgcatacgggtcacgggctgtaaagcgcaaagcgccttattaccgccggtcgggattttcacccagccccgaaggatacaatcaatatttttttgtccttatccgctattataacatcctttgcggcaggcgcaatgaatttgcacctcattattcagaaaaataaaaagcgcccttttcccataaaaggcgtctttatttattcgttcactttgacgaccttcaataagccgtcaatccggtttgatttgctgaaatacgctttaatcttatcacctttttgcacatcggagagatcctgcttcagcttgtcgccgttaaaaataatttttgtgccgttcgctgccgtaccgtggtactcagttccttcgattttcgtaattttatatgttttgactgtatattcttctttttcctgggacagggtttgtccgattgcagtcggcacgtctttcagttcaatatcgtttatgaccatataaccgcccgctaataacagcagcagtacaagtaaaatggctgcttttgttttaattcttcccatttttctacctccagcccgtatcaatctattcattactatgtcatattcctttttttcatgaatagaaaaccgttcttccctgcgtgagttattcatataacgtttcataaagggaagatgtttcatgtatctgtaaaactttctatctattaaatagatatacgaatttatgttctgtttttgagggtggagagataaatttatataaaaaaagcagttttctcatgaagaaaactgcctgtacggtttatttcgtcttgcgaatttcgttaaacgggaagaagacgaattttgatgtgcccgctatttgtttttttgtaaaaagaccgaggccgttgcggctgtccatagattctctgcggttatcacccatgacgaaatatttgtcgtccggcactttcaccgggccgaagtcttctgtcagccggtcatagccgtcttgcttcgccttgtgcttatttgccgctaaatacggttcggacacttttttgccgttgatatacagctgatcgtttttcatttgcaccgtgtcgccgggaagtccgataatccgtttgacatagtgctcattttctccgttcagcacgacgatctggtcgcgtttgaagtcgcttatgtatttgaccgtcatattgacaaagattctctcgcggtcatgcagcgtcggatccattgatctaccatcaacgagataaggggcaaataaaaagtttcggatgagcagtgccagaacgacagcgatgataatggctttcgcccaatcaagtacggcgctttttttagaagttttttctttttctgatttcaagtgatttcctcccattagccatggtcatttttattttaccatgaatccctgcacagagggcaaataagccccgcaccccatccctttttttcattttataagccggatctgctgattttacggtatttcacgaagcttccgatccgccaaatgcacaaatacacaaaagcaagctccatcgttaaaacggcgaattcagccgcgtcaatgcttttgaaatattggctgagtgcgatacggatcgcaataatcgcgataatgacatatttaaagtttttattccgcttggagtagacaaagccgtcttcccggatttcataggcggtttgcgacagcatgatgataccgaataccgcgcctaacagtccggcgatggcgagctcccaaagagcgggaaaatgaaacggctttcccgggatattcatgagctggctgatactgaatgtaaaaatgacggcgataatcaaaagcgggagaatgatgcctaagccgccgcctttaatcggcctgtttcccttttttaccctgaaccaaatcataagtgcgagaatgataatgacaaataaaacggttgccaattgaaccaacgtttctacctcttttcattgttgtaatcggtctttttcactataccagaatgatcaccgatgttcatatatgtattttttcatgatttacacatgagaattttcatatacataaaaaaaacccgcctgaaaaaggcgggttttccgtcattatccttctacacggatttctttcattttgtctccgttagacatgtttttcgcatgctctaaaccgcttgtcacttttccgaatacagtatgaacgccgtttaaatgcggctgcggctcatgtacgatgaagaattggcttgaacccgtgtctttaccggcatgcgccattgataaagaaccggcttcgtgtttatgcggattgccttctgtttcacatttgatcgtttttccgcttccgcccatgcctgtcccagtcggatctccgccttggctgacaaagcccggaatcacgcggtggaaaataacgccgtcataaaagcccgtattcgccagattttcaaagttagcgactgtattaggcgcttcattcggataaagttcaaattcgattctgctgccgttttccatttcgatgtaaccagttttcattctcattcctacttccgtattgttttttgtcaaagccttctttaatatgaatttcaattgtaagccggctttctttttgatattcttttgaaggaagaggcctctgctcttcttttcgcggctattataccacaccttcagccggaaaacgaatctccccgcttccgcagaaagaaaatgaaaccagaacagcttcacagccgtctatgtatcggaactgcttctcgcaggtcctcacaaaccgcttcaaaacggcatttgtgaaaagaaggaggttaaccgctttgaaaaaaatgtggattggattgctggcggcggccgttgtattgtgcacaataccgaaaatcagcctggccgatgccgcagtcggagatgtcatcgtcacactgggggcggatctgtcaaacgaaaaccgtcagaaagtgcttgacgaattaaatgtccctgataacgcgacaaaagtgacggtcacaaataaagaagaacatgaatatctgggaaaatatatatcgaatgcccaaatcggcacaagagccatctcttcgtcatccattacggtggcaaagaaagggtccgggcttgacgttaagacccataatatcgattccattacggatgaaatgtacttaaacgccctgatgacagcaggagtgaaagatgcgaaagtatacgtgacggcgccgtttgaggtatcaggcaccgcagcattaacgggaatcatcaaggcatatgaagtctcatcagacaaagcgatttcagaagatgtaaaacaggtcgccaaccaagagcttgtcaccacttcaaatctcggggataaaatcggggataaaaacgcctccgcgcttatcgcaaacattaaagatgatttcgcgaaaaacggtgtgcccgatacaaaagaaggaatcgagaaaaaggtcgatgatgcggcttcaaaccttaacattacactgactgacgctcaaaaagaccagctcgtttcattgtttaataaaatgaaaaatgcaaagattgattggggccaagtcggcagccagctcgataaggcaaaagacaaaatcacgaagttcattcaatccgatgaaggcaaaagctttgttcaaaaagttattgatttcttcgcttcgatttggaatgcgatcgtgtctgtatttacaggagacagcggatcaagttctgacagctgaacgcaaaaagagaccggacgccattgttccggtctcttttttatttattgtttgaccccagtcttaaacggcagatccagttttacaatgtcttcataagtttctcttctaatgacaagatgcgcttcgccgtcttccacaaaaacgacggcgggacgcggaatacggttgtagttgttagccatgctgtatccgtacgctcccgtgcagaaaacggcgagaagatcgccttctttcacttccggaaggtctatatcccaaatgagcatatccccgctttcacagcacttacccgcgatggataccgttttgtcgtggtgttctccgattctgtttgccgatacggcttcatatttcgcctgataaagcgcaggacggatattatcgctcatgcccccgtcaaccgctgcatatttacgggtgccgggcacttctttttgcgaaccgatggtataaagcgtcgttccggcatctccgacgagcgagcgtcccggttcaatccagatctccggaatgtcaaaagcgtgcagcgctgcgttttcttttaccgcttcgataattttttccacataaacggcgggatgaaggggttcatcctcttccgtgtagcggatgccgaagccgccccctaaattcagcacttcagagacaaagccgaatgattctctccattcattcagttttgcaaagattttttctgcggccagcacaaagcccgccgtatcaaaaatttgcgatccgatgtggcagtgaacgccgagaaggcggatatggtctgactgcaatacttgttcaatcgccttttctatttgcccgttatgcagatcaaaaccgaatttggaatcttcctgccccgttgtaatataatcatgcgtatgggcctctacccccggagtgatccggagaagcacatccattgtgcgccctgatttgcggcacagttccgcgagtaaggatatttcataaaaattatcaacgacgatgcagccgatttgatgatcgagcgccattttcaactcttctttgcttttgttgttgccgtgaaaatgaatcctgtcagccggaaaaccagccgcaaccgccgtaaacagctctccgccggatacaacgtccaatgagagcccctcctgctcagcgagctgtatcatcgcaacggaagaaaacgccttgctcgcgtacgcgacctgcgcctttaaatccgcgtcaatgaatgcctgtttaaagcttttagcgcgctcacgtattaaagccacatcgtaaacataaagaggcgtgccgtaatgctccgctaaatacagcgcgtccacacctccgatttccaaatgacctagtttgttttgtctgcttgtgccatgtaagaacaatgctcattccctctttctgatccgcctatgggtgaaaaggacagcttcttttgagctgtccttatacaagtcccgtataagttaagacatacaatatcataatcttctgtcggtttcaatgcgattatgaaccgcttggctgtctttgacggtctttcgggtgaacaatgctcggtctgactttcgctcccggcactgtcgtccggacgagcacctgccacagcgccttgccgttaaacggtaaaaacggccataaatacggcgtatgaaacgaacggatattcgccattatgatcagcagcaatgtaaagcctatcacaaagcctttcacttggaaaatggccacgagcaccattaagatgaggcgtatcattttattggcgaggctgagctcataactcggcgtggtaaatgatccgatggcggcgatcgatacatacagaatcacttctgctgaaaacagccccaccgctatggcgatttgaccgatcagcaccgccgcaatcagacccatggcggtggataaagcggtcggcgtatggatcgcggccatcctgagaaactcaatccccaaatcggctaaaaagatttgcagaatgatcgggatgtgcgtatttttatttaaaccgataaaatccaatctttcaggcagaagagacggttcgagaacaaagagaaaccagatcggaagcagaaccgttgaagcgataataccgaagaacctgatccatcttaaaaatgttcccactgaaggcgcctgcctgtattcttccgcatgctgaacatggtgaaaaatcgttgtcggcgttatgatcacgctcggtgacgtatcaacgacgatgatgacgtgcccttccaaaatgtgattggcggccacatccggccgctccgtgtatctgaccatcggaaacgggttgtagccctgtttgacgatgaattcttccactgttttatcagacatcgtcaatccgtcaatgtcaatcgcattcacttcgttttcgacgatgctgacaaggtccgggtccgcgatgtcttctatatacacaatggcaagatcggtcttagagcgctcgccgactttcgtaattttgacgcggagcctttcgtctctgattcgtcttctgatcaatgctgtattaatgacgatattttcgataaaaccgtctcttgccccgcggacgaccttttccgtatccggttcttccggtgtgcgtccggggtaacttctgacgtcaacgataaaggcgaagcccgcgtcttcaacgataacggccacaagtccggaaagcacttgatctgttgcttcgtcgagcgttttgactttttggacctgctgattgacaagcctgttttcaacaacgtcaatcgcttcatccgcattctcatcataattattgacgtcgacgagctgttccattaaatgaatgataaacaaagtatcggttaatccgttgacaaagtaaatctggacttcccggtctaatactcgaactttgcggacgccgacatcatagctcgttcccataccgacgcggtctttaaaaaattgttcattttttctaggatcccggtataccttgatcatgttttccggtttttccggcatgactttcgctcctttctaaaatgaattcgaccgccttcatcgtaatcggcgagcctttggatatgtcatcttttctccccatctttcctatgtcgccgatgcccacaatgagaggaacgtccaatttatccagacaatacaccgtatctccgttcattctgtgctcgtccatttctctcattccggttttatcgacgccatactccgtcacttctccatcacggtcaatggagacatcgactttcgtccattcagcctgatgggtcttagaagcgaccgcaatcacccccagcacttcaatgtcctgatgtgaggcgacatatttcagcgccgtttcgcccggcccttccccttgcaggcctgaatcgtcaaacatgacaaacaccgggtcattcggcgcggctttaatcagctgaacaagttcggggccgcttctggttgacggattgccctttgattgggaaatacaccgcccgcctgctttttccgcggcatattcaattgttttggcggcgtatacgtccccgtctgtcacaagaatgaccttccgtttcgtcatcaggcattatcctttcggtttaaaaataatggctacaagaaatgcgaataaaatcgctgaagatataccggcggaagtaagttcaaaaatccccatggcgatcccgataaatccatgctcgtgagcttgatgcatggcgccgtgcaataagctgtgaccgaagctgacaatgggaaccgtcgcgcccgcacctgcaaattcgataaatttgtcatatattccgaacccatccaacaaggcgccgatgacgacaaaagttgtcatcacatgggcgggtgtcagtttaaaaatgtcaagcagcagctgaccgataatgcatatgattcccccgcaaacaaaagccaacagatattccatttatgatgcacctcccgcccgctcaaataccacaccgtgcgcgatggtcggaatggtttctttctgctggatcattgtcggacttaaaagcgctcctgtcgcgacaacgagcaccctgttcagagcccctgattttaattgattaaaaatatgtgtgtacgtaacaagcgcggagcaggcgcagccgcttccgcccgcaaacacctgctggtccggcgtatagatgagaagaccgcagtcatcgtgtttcgttccggcgggatagccttcttctttgagcaaatctttcacgatcggcgagccgacgcctgaaaggtctcccgttaaaatcagatcataatcatccgccgtgcggtttaagtcctgcaggtgctgtttgattgtgtcggcggcagcgggcgccatggcggatcccatatcgaacgggtccgtaatcccgaggtcgcttacttttcccactgttgcgcttgtaatcttgatatcagaagggttttggctgatgatgaccgccccgccccccgtgaccgttgaagtggcggtatccggtttttgcccgccatactccgtcggattgcggaattgccgttctgccgtcgcgttatggctgctcgtggctgcgatcgcccggttcgcaaaaccgccgtcaatgagcgcggatgcgacggcaatcgtttccattgatgtcgaacaggcgccgaacagacagaggaacggaattttcagatgtctggcgacgtagttggcggtcacattttgatttaaaagatccccgcgagtaacaaatcaatatcgctctttttcaaattctgtttttgcaaagctgagttgatggcatcttccattaactgacgttccgccatttcccagtttttctgattgcaatgcatttcatcgtatgtcttatcaaacagcgaaccgagcgggccgtctttttctttcggtccggctgccgtccccgccgcatttacaaataacgggttttcaaacacccaggtttgctttccggttaatttcattttttctcctcctacgaaaacagtttttcacaagcaaaccgtatcaggcctacgatataggctgccacgacgccgaatacaatgacgtttcccgccaatttaaacatgtttgtcgctactccgagcacgagtccttcacttctgtgttccagagccgcgcttgtcatactgtttgcaaaacccgtcaccggcacggctgaacccgctccggcaaactgcccgagtctgtcataaatgccgaatccggtcaaaagggcggaaattaaaataagagtggcggccgtcgggttgcccgctgttttttcattaaaattaaaaaagtggatgtaaaagtcttgaagagcctgtccgatcagacagatcaaaccgccgatcagaaaggctttgacgcaattccaaacatatggcggtttcggctgatagtctttcacttttgttttgtaattttcttttaagtttgtcacgtcggttcctccttatgaatgatggataaaatacagccaatgaaataaagagccggctattttgccgaacacaatggccatcagcaatataatgattttgctgccgaagccgatccgtttggcaagaatgggaagcacattcagcacttctgtaagcgcggcggccagcatgccgataaacatgccggccaaaagcccgaccggaacggccagccattcagataaaaaaaaatgattcatatttaaggtttcccagccgccgaacacagctcctgaaataactgctccttcgtaggcctgtacaaagcgcattgtttttgtcagctgcataaggcgggggacgattcccataacggttaaaaaagccacaaagcccgcgcccacggtcagccctccgccaagcccgacaaatacaacgaaaagaatgctaacgatcatgcagatctttcatcgtctcttcattttcgtgcattgcgacataatgatcgagatcaagctgataattaaacatctcgacttccagcgggcttggctcttcattcaggcgttttttgaagatgtgattaaaaaagacgatcataccgagaccgaggccgatgctgtatggaatctgaagcagatacgggtattcattccgttcgcccgttatgatttcatataaggcgatatgaacttctctcatactgacatcttcatgaaaattcataatggcaagacatgaaccgataaaaagcaggagccagacaccgacgaataaaacggctgacagctgctttttctggtaatggatttccactatcgtttcagcgccgccgacggcctgtacatcaagcgcgggaaaagcggtatgaatggttttcagcacttttatgatgtccagcacgacgatatttttgtcttttttcgtgaccttatacagcggcagtgccgacagtttttttttcagcttttgctgtcccgcaatctgcgcggcgtcgccgactgtgatgatatctccggtatgagccttcacgcggtggcgaagtctgagaaatattcgtctttccatcttgcatcaccatctttcgggtggttatatatgtagtatgtggttcacttttgttctcattcatcagccgcaaaagaccataaattaccaccgatgcacaaataaaaaaagccggcccgtaaaaggtcagctttccgtatgatccatctgcactttaatctgctttaatatttttttctccagcctcgatacctggacttgggaaatcccgagccgttcggctacttccgactgtgtctgatctttataatatctcagatagacaatgagtttttcccgttcttccaaatcactgatcgcttccttgagggcgattttgtcaaaccacttctcttctgaatgatcggcgatctgatcaagcagggtgatcgggtctccgtcattttcatacacggtctcatgaatggatgaaggcgcccgcaccgcttcctgcgcaagcaccacatcctccgcatcaatttctaaatgatccgcgatttcctggacggtcggcactcttccgtatgtttttgacagttcatctttcgcccggcgtattttattgccgagctcttttaaagatcttgatactttgacggttccgtcatcacggatgaagcgctggatttctccgataatcatcggcacggcataagttgaaaaacggacatcataggacaaatcgaatttatcaacggattttaataatccgatacagccgatctgaaacagatcgtccggctcatagcctctgtttaaaaacctttgaacgacggaccacacaagacgcatgtttttttctatgaggaggtctcttgcctgctggtcgccctcttggctctttttgattaattctttgacttcatggtccttgagctgcgcgtttttgctgtttttcttaacctccacatccataacaaatctccttaattacaaagcgctttgctttttgataggtgttttgttaagcgtatcgtcgttcccatctccggcgaggaatcaatcgtgacatcatccataaagttttccataatggtaaagcccattccggagcgctcaagctcgggttttgtcgtaaagagcggctggcgcgcttcctcaagatccgtgatcccgaggccttcatcacgtatggtcagatagacgacatgatcctccagcgtaacggagatgtacacctttccgtcgcagttttcttcatagccgtggatgattgcgtttgttaccgcttctgatacgacggtcttgatttccgtcagctcatccatcgtcgggtcaagctgcgcgataaaagaagcaaccgttacgcgcgcaaacgattcgttctgactgagggctgaaaattcaagatgcatctcgtttttcatgaagccacccccaacgttaaaagcgctttttgttccgattgttcgaacctgatgattttaaacaggccggacatgtcaaacagacgtctcaccgctggcgaaatcgcgcacacgaccatttctccgccgagctgtttaatttgtttataacgccctaaaatcacgccgaggccggagctgtccatgaaggtaagatcttcaaggttcagcacaatgtgacggatgctgtcagcctccagcgattcagtaaccttttgttttaatgattctgccgtatgatggtcgagttcacctgttaatcgaatacaaagcacggattctttgacatgaaagtcaattccaaggctcatgctcattcctccttgtatgatcggataatgagtgtttcgattttcgggaaagcaattccttcactatgacaaaactagtgcccgttcgccatgattatttaaattttgtccaatctcccatcgtccgcttcagaaaagtgagaaaacccgctttttccatgtcgtcttttgccgtgaccgggctttcaacgagcacctttccgtcttttttcagaacgaggctgccgagcacctctccttttttaaccggagccgttacattgccgttgattttcacttctttttttactttgtccatgttctctccctttttggccagaagagaaatcggctcagatgtggtcagcttgatcagtttctgttttccttttttcacttttaccgttccgacgatttgattccgtttgtacagcgggtgtgttttgaactggctgaaggcgtaatcaagcattttggtcacttgggcgtttctttctttcggggtgctggctccgaaaacgacagcaatgaccctcatattcccttttttagcggtggcggttaaacaatacttcgcttcgcctgtaaagcccgtcttcacgccgtctacacccgggtaaaatttgatcagccggtttgtattgacgagccagaactttttgtctgtattttctcttaaataatcctcatacgttcccgtaaattgagtgattttatcgtactttaataattccttcgccattttcgccatgtcataagcagagctgtaatggtctttttcaggcagtcctgtcgggtttttgaaggaggtatctttcaatcccaattcttttgcttttttgttcatccggctgacgaaatcctcttctgaaccggcgatatactccgccattgcgacagatgcgtcatttccggaagctatcgcaattcctttgagcatttcttttaccgtcatttcttctccgggttcaaggaaaatctgtgatccgcccatggacgcggcgtgttcactcgtcctgactttatcgctcatctttattttccctttgtcaagcgcttccatgattaaaagcatggtcatgatttttgtcatgcttgccggcgccagacgctcccggctgttcttgttataaagaatgcttcccgtatcgcgttcaatcagcacggcgcttttggcttcatgagcgagctccgatgtatgttttccgtccggctttgcaaaagcggacggtgctgatgccgttaataaaatgccaatcaacaaagtggatataagacgtttcatctccaaagccctccatttcataatcctttttattttttccaaatccggtggttttatacgcctcatctggaaaatgtttcgtgttgagggcacaaaaaaacagctgcttccgaagaaacagctgacttatgctgacttatttttgagatcgtgcgactacggctttgacaagcttcaaaaagccgccttttactttttccgtcatttccattacttcttcatgagataacggctggtcaagaatacccgccgccgcgttggaaatgcatgagatgccgagcacgcgtatccccgcgtggttggcgacgatgacttccggcacggtcgacatgccgacagcgtcagaccccatcgttcttaaaaaccgaacctcagcaggtgtttcgtaagacggccccgtaacagctgtatacacacctttttgaacaggaatgcccagctcatcggccgttttttcagccaagcttgacagctctttgtcataggcttctgacatgtccgggaatctcgctccgaattcagcttcgttcggcccgattaacgggttggtgcctgtaaagttgatatggtctgtaataatcatcagatcgccggcgcggaattcagtgttgataccgccggctgcattcgtcacgacgagagattcaacgccgagcgctttcatcacgcggactggaaatgtgacctgatccattgagtagccttcatagtaatgaaagcggccctgcatcgcgatgacctgcacgccttcaagcgttcccatcacaagctggccggcatggccttctaccgttgagaccggaaaatcagggatcgtttcatatgtaagcttgacagctccttcaatttcatcggccaatacgccgagccctgaccctaaaatcagaccgatctttggtgtttctttcacgtgttctttaataaatgcagcagcacgttcgatcttttgtttcaaaaaaagtccccctactgtaatcttgataaaaagctttttccgtattccggcttttccgttttaaaattatcggcaatagttgcgccgatatcggcaaatgtatccgcaagcggcagctgttctgtatgtttgtgctttttgctgtaaacaagaagcggcacatactcccgcgtgtgatccgtgccgtgatggacaggatcattgccgtgatccgcagtgataataagcagatcgtcttctttcattttttcaaacacttccggaagcctcgcgtcgaattcctcaagcgcttttccgtacccttccggatcgcggcggtgtccgtacagcgcgtcaaaatcaacgaggttggcaaagctcaggcccgtaaactcttcaccgagcgtttcaatcactttgtccatgccatccatattagataccgtgcggcgggaagatgtaatgccttctccgtcataaatatcagaaattttgccgatggaaatgacgtctaatccgctgtctttcattccgttcattaccgtgcggccgaacggtttgagcgcataatcatgacggttcggcgtgcgtttgaagctgcccggctctccgacgaacggtcttgcgataatccggccgaccatgtacttcggatcaagcgtcagttctctggccgtttcacagatgctgtacagctcttccagcggaacgacatcttcgtgagccgcaatctgcagcacggaatctgctgatgtgtaaacgatcagcgcacccgtttccatatgttcttttccgagctcgtccagaatcgccgtgcctgaagccggcttatttccgatgattttccgtcctgaacgccgctcaagttcctgaagaagttcatccgggaatccttccgggaacactttaaacggtttttcaatgtagaggcccataatctcccagtgccccgtcatcgtatctttcccgtttgacgcctcctgcatttttccgtagtacgcaagagggtgctccgttttttccacgcccttaatgtctccgatcagtccgagaccgagctgcgccatatggggcatatgtaagccgttcatgtgctctgcgatatgtccgagcgtatttgcgcctatatcattaaaatcggcggcgtccggcgcttcaccgattccgacagaatccattacaattaaaaatacccggttatatttgtattcagacatcataaaagcctccttttcttccatctgtccattgtagcttacagaggtcagacaactcaagtataaaccgtttacattcttgttgacaatgccgattcaaataattagaaccttctctgtattccgccaatccggcaaaaaaagccgcggcccctctggcagcggctcctaagctcgcggatgatactgtttgtacacgtccttcagccttgttttcgtcacatgcgtataaatttgtgtcgtggaaatatcggcatgtccgagcatctcctgcacggcgcgcagatccgcgccgttttcgagcaggtgcgttgcaaaagagtgccggagcgtgtgcggtgtcagctcttttttaatccccgcttcaagggcgatttttttcaggtttttccagaatccctgacggctgatctgcctgccgtgatgattcagaaaaagcgcttcggttacgtttttctttaataatttccctctggctttttcaatgtatgcttctatcgcatgggaagcggcttcaccaatcggcacaatccgctctttccgcccttttccgaagcagcggacaaatcccatcgtcaaatggacgtcggataatttcagctcgatcatctcgctgacccggatgccggttgcgtacagcagttcaagcatggctttatccctgagaccgaacgggctgtcaagcttaggcgtgtccaataaccgctcaacttcgtgaagcgccaatactttcggaagcgtccgctctgttttttgtgtttcaatatgtaccgaaggatctttatccgcggctttttcccttaacagaaattgatgaaaagaccggatcgacgccaaatgcctggcagacgtcttgccggatttcccggagtcctttatatgctttaaatattgaataatatgaagacgggtcacatcattccatgaagtgatctgaagggtttcagttaagaagagagaataacttttcagatcacgctcataggacatcatcgtatttagggacagccctctttcaaccctcacataatggatgaaatccttaatttgatccttcactcttgatctactccccgttttggtaaaaaaagatcaatcggccgaaccagccgtctttctcctcatgttccgttttggccactttgacggcggagccttccggtttatcgtaccgatgatagttttcatactctgaattcacccatatcatagcataatagaacagcgcggtaaaacctgtgaacagaataaacactttgatcgtatccgcggctgttttcaggaatctgcccatctttcgatcgaccctttctttggcggctgttagtacaccttatgccaatttcaaaggcttttatacataaaaacagcaaaaaaccctttcctggcagaaaaggttcataggcttttactctgtttcatccccgcggcagcggtggcagattccgtgaaaagtcaatctatgatctttaattttaaatttccaatcacgttcaatcacttcttcaacgtcttcaagcagatcttcttcaatttcatcgacggctccgcactccatgcacaccaaatggtgatgaaaatgagccgcgccctctttgcgaaggtcgtagcgggatacgccgtccccgaagttaattttatcaacgacttttaattctgttaataattctaatgtacggtatactgtagcgagaccaatttcaggagatttctcttttacgaggaggtatacatcttctgcgcttaaatggtcttcttcgttttcaagcagcactcttaccgttgcttcccgctgtggcgtaagcttgtagcttgacgagtgcagctgctttttaattcgatcaatacggttttccatgtctttccctcctacgccgcattccatgactcattataacaaaatacgcgcagagttccaactataattattataaactgataaataaaagtattattttgtgataataattctaaaatatgcgtgatgacagcttttccataaacagcggagacatgtacgcttcgagcagtgaagcgaggaccgagaagaaaacgatgagaatcagtacgaaggcgtagcgtccgaaccattggatcggcgcgtcatgaaggctgcgtttgacaaacagctgccggatcagtttcagtgaaaaagcgatggagcatgtccccatgataagatatgctggaatgagaacgatgttttgcggcagaaccgaaataaatgacaggaaaaacccgttcatccccatttgattcactaaaaaaccgaccgtgaagccgacgacgattccttttaagaacaccataatgaaaataaccggaagaccgatcacggaaataccgagaatccacatcagccccaaatattttacatcatgaaagacggcctgccaaaacatttctgaagcgccggcatgttttccgtcagacagctgtccgaaaaacttgcttaaatagtaatacaaatcttctttctgcgtgatggtcatgctgttgacgatgatcgccccgaaaatgacccccatcaaaaacaagacgaacacaaatatataaagtgacagatgatcctttacatggcgaaaaaacagttctttgtacgattgttttctcataccgctttcctcccgctaatctattgacttgatttagtagattgtatgaaagaaaagagaaaacatgacagagaaatcatagaaaggcgcgagattcgggcataaaaaaagaacccccgtcatcactccggtgatcataggggttcctttttttatgctttattctttcaagcctgtcttttttagttttcgtcactctttcatgggtgctgaaaggcggcgccgtcccccttgacaagactgcgtcacgcatcccgtttcttctgagatgctcccgcatttttttcgttttgctcttcgccatgtgccaatcgctcctttttgccttttctttatcataacaaaaaaatcccgatgtgttcatgaatacggctcatgtttcgaccggtaagcgcgcagagacgttttggcagatgaatagctccccatagcggcgtatccgtaaaaaaatcccatgaaaatccccgcatacacgtgttcatggtgaccgaaaacgatagacacaacatttccggcagcaagggcaatcgtgggaacgaatatgcccggaacccggcagaacactttgatcagctgtgtaacgcataagacgaccggcacgccgatcacagcatcccaaatatttgtatggatcagcggaaaataatccacattgacacctctttattccgtcttttgctatctgttagcctgcctaagaattccgtttcctattcatctaaaaaaacagcaccggcacatgtccggtactgtaagagttgtttattttcctgccgcggcccgttctacggctgctgatacagcctgatgcacgtccgcatccaaaggctgaggcacgagatcgccgtgttttgtgcaagaggcgatggcttctgcggccgccacaagcatttcatggtcgattttcttgcttttggcgttcagcgcgccgcggaaaatccccgggaagccgagaacattattgaccgagcggccgtcggctgcataagcggctccggcttgtaatgcgtcttccggttcaatctccggcttcggattagataaggccagaatgacatgtccttttctgacatcctcttttttaatgagacccggaactccggtggtgctgatcacaatgtcacacgtgtccattaaatctttgatgcttccaagcggctgacctccgtactgagcgaggcggttcattgcgtcttctgacttgtccgttccgcagaccgctttgactccgtatgccataaacatccggcagatggcgacgcctgccgcgccgagaccgatctgtccgaccttcgcttcttttaaatcaagaccggcgcttttacaagcggaaatggcggcggcgagcgtgacgaccgccgtgccgtgctgatcatcgtgcataaccggaatatccagttcttctttcaggcggtcttcaatgtcaaagcagtgaggcgaaccgatatcttcaagcagtattccgctgaaccccggagaaatatgttttaccgtgcgaataatttcttccggatcagaggtatcaagcaaaatcggaattccgctgatacccgccagctggtcaaaaagcgcggctttcccttccattacaggcattccggcgacagaaccgatattgccgaggccgagaatcgccgtgccgtcggtgacaatggcgacagaattgctgattgtcgtatagatggacgctttttcaggctcgttttcaatcagtcggcacacatcggcgacgcccggtgtataaacacggccaagctcagccaatgtccggatcggcattttgcttttcatttgaattttgccgccttcatgagcagagagcacttcatctgagactgtatgaagccggatgccttcaccgagagcttcaatggcttgaatgatttcctgcagctgctcctcattttcggcctgcaccgtgatgttgcgcattgtgtagttcgggccgactttaacggtttcaacttccccgatatctccgcccatcactccgatggcggttgccacttttccgagatttccgggaacagtcggcgtttcaatcattaacgtccgaatcatatgctttgtaatcatgaaatgaacctcctaacccaatttttgagattgcaaggatttttctttcgtgtaccaaatgaatttccccgtgtatccgtacaatattgccagtccgatagatacaaaactgagccacatgaacggcagatatgaaaatgtggatacgccgagaatgccggccatatagatgccgttatcagaccacggcaccatccctgaagtaagcgttccgcccacctctgcgttccgggataaaactcttctgtcaagtttcagtttatcataactgttctccatgattttcggcgtcaggatcaatgacacgtacatcgcacagccgaaaatgtttcctaaaagggcgacgatcaatgtcgaaagcgtcacatttcccggtgtggtcagctttttctcaaaagttgagacaatcacttttaatacgccgagcttctcaagaattcctccaaaaccgagaccgaacaggataacgactaacgtatccagcataccggtaatgcctccgcggtttaacaggccgtttaaaaattcgacgtccgttttaatagaaaaaccattataagcagtcgcgatggcactggcaaaattcattccctgaaagacggaagcccagattgcgccaagcaaagcaccgatgataataacgggcatagacggctttttcaaaatcagaaggacaacgacgacaacagccggaatgagcatccatatatgaatatcaaacgttttctgcaatgaagattttaaaaattccactttgtcgagatcaatattttttccgccgtatataaatcccgttacggtaaatagaatggccgtaataatataggacggaattgacagatacatcatcgctctgacgtgcgacagcacatccaccttagaaagcgtggaggcaagcaccgtactgtcagacagcggtgaaagcttgtctccgaagtaagcgccggacaaaacggctcccgctacgatcggaagcggtatacccattccctctccgatggcaatcatggcgatccccgcggttcccacggttccccacgatgttccggtcgcaacggacataacggaacaaataaccagtgtagccagaaggaaaatatgaggattaataaactctaaaccataataaattaacgtcggcacaacaccgccggcaatccatgtcccgatgagcgcaccgaccgaaacgagaatcaacaccgcttcaagaccgtttgatatcccggtgacaatcgaatcctgcaagtctttatatgaatatcccagcctgactccgagaataatagcgaaaaaccaggatattaatagagctagctggatcggcaggtctaaaaacactgtgaacgataagacaagtgctaaaaacccgaataataagataataatttccaataaatttggcaatctgacctctttcacaagaaaatccccctagaagaaaaaagctaaaacgctttcatcaaatgatataacaaattatactatactgcctcatccctttgtatggcaaccgcctattcactgaaaaacgtgaaaaggcggctgttgttgctttaaaatttatttttctaatagatcttttccggcaatccccggttttgtcatttcatacggattcaaaatgatatccaattcttcttctgtcagtacatcattttgaaggcaaagatctcttacagattgccccgtcatgatggcttcacgggcaattcgcgcagccgcttcatagccgaggtgcggattgaccgctgtaatgacgccgacgcttttttccacgtattgcttcagacgtttttcgttggcttcaattcccgccagacaatgatcggtaaatgaacggaacccgttattcatgatgctgatggattgaagcaggttaaatacgagtaccggctccattacgttaagctccagctggcccgcttctgaagcgaggcagatcgtattgtcattcccgatgacctggaaggcgatttggttgatcagctctgccattacagggttgactttcccaggcataatggatgatcccggctgacgggcgggcagtgaaatttccgcaagtcccgcgcgcggacctgaagccattaagcgcagatcgttggcgattttagacatgttcatcatgcatactttcaacgcggctgaaacttccgtatacgcatcagtgttttgtgtggcgtcaaccaaatggccggcgccgacaagcggcagtccgctgatgtcagccaggtgctttacaacctgttctatgtagcgcggatcggcattaagccccgtccctacggccgttgcccccatgttgacttcatacagatgctggcgggattgtttaattcgctttatgtcacgctcgagcacgcggctgtatgcttcaaattcctgtccgagacggatcggcacagcgtcctgaaggtgtgtgcgccccattttaatgacagaatcaaattgtttcgctttatccttaaagacactcagcatatgcgccatcgtatcaaggagcttatccaaaagttttaaggtggaaatatggattgccgtcgggaacacgtcgttcgtcgattgggacatgttgacgtgtgtgttcgggctgaggtgaatgtattcaccttttttatggcccatgatttcaagggccctgttgccgattacttcgttggcattcatgttcatggacgttccggctcccccttggatcggatcgacgatgaattggtcatgccatttcccctcaagaatctcgtctgcggcctggacaatcgcatttccgattccttcatacagccgttttacatccatgttggcaagcgccgccgcttttttgacgatggcgagcgcattaatcatctcttcgtggatgcggtagccggtaatcggaaagttttctttcgcgcgcagcgtttgtattccgtaatacacatcagcttcaatttgtttttctccgaggaaatctttttcctgacgatattctttttgcgcgtttgtcatgctaaaaccctactttctctttgtggtagtcatgtttttacagtacaacgtcgtctgcgatcggtgtctccataatgtttttgacttcagccaagttgtgagactggccgagcgcccacattaatttcggcacgatggcttccgtgttcatatttctggagcggataatgagatcttgattgactcttcggccgacttcatagacgctcatgtcctctccttcttcaagacattgtgtcgtaatgacgacgacaatgccgctttcaatcatttcattgactttggcgagaatgtctcttccttcaaacggcacgccgccgctgccgtagctttcaatgacgatccctttgtacatgccctttaatgcgtcaaacatttccggtttcagccccgggtggagcttgagcaggcacacgtccgtgcaaagtgaggtattgaccgtaaaggcatcgtcttttggcatgtgcacttgtttgttgtattcaattccgttttcggtaataaacgcgatatacggatagttaatgctctcaaatgcatcatagcttttcgttcttaatttaatggcgcgtgtgccttgaatgactctgccgtcaaatacgacgtatacgccgcccaccccttcacatgcgaagcggatcgcgtccgtgatattttttttggcatcggttttttgaaatgtaatcggaatttgcgaacccgtaatgacgatcggtttatcagcatgctgaagcatataagacagtgccgctgatgtatacgccattgtgtctgtcccgtgcgtaatgacgaacccgtcatatgcgtcatatttttctttgacagcatttgcgatttcggcccagtattcaggctgcatatttgtgctgtcgatgttcattaacgaatgggtttccatcgtgtaatcgttatcaagttttgatacgtaggttaacaattcgtctgctttcaccccgggtgcaagcccgttttctccttcgactgaggcgattgttcctccggttgttaacagcaataattttttcataccctgcacctcttcatccatttctcaagatgtgttaagcattcgcttttcgcatacttttaatcaaattatagacagacgattgaaattaatcaagtgattattattcaattcgcgtacacttttgcatatcgatatgatataatttgctcaagtgaaaaggagcggttttgaatatgaatttagatcgtttaactgaactgagaaaaaagaaaaattggtctcttcaatatacggctgaccgtctcggcatcgccaaaagcacgtacgccgggtatgaatcaggataccggcgtccgtcattcgaagcgctgggcacgcttgccgatctgtttgacacgacgtgcgacgatttactggggcgcactgaaaaaaaggcggagccgtttacccagaccatcgaattaacaaacgccgcacaaggccgcggcacactgaccgttgacggacagccgctgaatcaggatgaaatcatcgaattgattgcgtttgtccgcacgaaaaagaaggtgcaggaggagctccgctaaaatccggcttttacgacttgattctgccgtacgtccctccgcccccggcctcaaggacgagctgcccggtgcgcgctttatgaatgacagccgctattttaggctggacgacatgcgccaattcctcttcttgcgcctgatgaagaatcgccatctccgtcccgaaagcccgcttcagtttgtctaacgttttcggcccgacccccggaatgaactgcagcgggatttgatgaatatacggcggccgcggcacgcggctttttttcgggccgctcagttcctccagccgttcactgaccccttttgtcatagttttccccccgcactccggacaggcggaagctcctttttcaaccgggctgccgcagcggtcgcaagccgtccggtaatacttcccgagcttcgggttcagcccgtaattcgccgtgatttttcttccgtccttcccttttaaagccagcgaaaattccgtgaaattcgcttctttaagaagcatttcattatattctctgccgatttttcctaaggaatgcgcatcagaatttgttaaaaatgtatacggatcaagttccgttacccgcgaagccatgtcggtgtcgcagcttaatccgagttccgccgcatcaatgagcgccgggtcgaaaacttctgtcaaagaagatatgaccccttttccgtacaggcttttatgcggggtgaacatatgggcgggaataaacagcccgcccaattcctttgttttcctttgaagattcaaaccggtttcataaatacgctgggaactgagatggatatttttaagcctttttgcgagccactcagaaaacatcttcatttcggcaagagacggcataaagacgagaacgtgaatcggcccgcggcatgtgtgatcatagatttcaagctcactgcccaacagaagcgtcgtattccgataccggatgccgccttctttcagctcacggtatctgccttcatcaattccgcgctcgatttcttctatgacttccggggaatggcagtcgatgatgcccaatagttcaattcccttcccctcactggcctcttctaaaatccgatgcagcgtcaacgttttggccccggtgattttgaccggttttcccgtataggtgcggccgatatgaatatgcagatccgcatagatggttttcatcatttttccttcagtgcttctttcagctgcagatactgaatcgcgtacgccgtttttgcgtcatacaccctgcgggattcaatcagcttcacggcctcttcaagcgtgacctgcatgacttcgacaaattcatcctcatccagttcgcgcttttcttccagcggcgaaagcccttccgcaagaaagagatgcacgatttcatcagcaaacccgggtgatgtataaaaagcggtgattttcgtcaaggtttccgccgtatatcccgtttcttcctcgagctctcttaacgccgtatgttccggctcttcccccttttcaagcttcccggccggaatttcaacgattgtccgttccagcggctttctgaactggtttaccaaaatgatttttccttcttcggtcaccgcaagtacggccaccgctcccggatgtttgacgatttcccgcttgcttgtttttccgttcgggagctctacatcctctaagtaaagatctatgactttcccgtcatacagcttttttttcgcaagtgttttttcttctaaatgtttcatcatgtcatctcccgttctgtctctctattatgcctcatatattttatcatacatgcatgagagggaggtgcttttcgattgaaggtgtaccggaaggataaaagtatcgtattggtcggaaaggcgtgggaagtgcgggctaaactgaaagaatacggacggacattccgctatgtcggagattggatcaccgggccttaacagttgaaaacttcgcgcctttatattacggtcaataaaagactataaaaaggagcgaaacgatgagaaaacgcacactgggacattctgatttagaaataagcgaaatcgggctcggctgtatgtcgctgggcacggataaagctgaagcgctgtctattttggatgaagcgatcgagcttggaatcaattatttagataccgctgatctttatgatttcggcagaaatgaggaaattgtcggggaggccgtcaaaaaccgcaggcacgacatcattttagccacgaaagccggaaaccgctggaatgatgataaagacggctggcattgggacgcctccaaaggatacataaaagaagcggtcaaaaacagtctgcgccggctgaaaacggactatatcgacctttatcagctgcatggcggcacgatggaagatcatattgacgaaacgatcgaagcgtttgaggacttaaaacaggaaggcgtcatccggtattacggcatttcctcgattcgtccgaatgtcattaaagaatatgtgaaaaaatcaaatatctcaagcgttatgatgcaatacagcctgctggaccggcgtcctgaggagtggcttccccttttagaggagaacggaatcagcgtagtcgccagagggcctgtcgctaaagggcttcttacggaaaaaccgcttgatcaagcagccgcaagcgtaaaagagaacgggtatttaacatattcttttgcagaattggaagaaaccaaaaaagcgatcggcgctgccgcacctgacttgagcatgacggagctttcccttcaatacttactgtcacagccggccgtcgcttctgtcatcaccggagccagctcacttgagcagctgagagaaaactgttcggctgcagaggcccggcgtttaagcagccaggaaatcaaagccctgcaataccatacaaaacgggacgtatacgaagcccatcgttcttaaacaataaaaccggcaccttgtcagatgccggtttatttatatttgtgccaatcgagactgctttcattcagcagctcttcaaagcttttatgtttttctttttcttttcgctttctgatttgttccgctttttgctgcgcctgttttttctcgtcttcttccttcagctcacttttcatttgcaaaagcctggccttcagatcttcctccagatcgtcttttaagctgtgtttttctttaggcagctgctttttcatcattacgccccccgtatctgaatatggtgaagcaagtgtaccacggagcgccggaggccggcaacgttcacggtcctgaaaagccggaggaaggatttttcatatgaaaggagggcccctgtgtgaaaaaatggctggcggtgttcggttcggcttgcgcagtctttttggctgccggattcgcttttacgaatctcattatgtttatgaagaaaaagacggatgaagatatcatgaaaaaagaaacggcggacgggcatgatagatttgattcctttcaggccatggaaaaagaagaggccgtcatcctgtcacgccacgggtatgagatcaaaggcttttacgtcgccccgcatcatacggcaaacgccatgattatttgtcacggcgttaccgtaaattcgttcaattcattgaaatacatggatttatttttagattcaggctggaatgtgctcgtatatgaccaccgcgggcacggaaaaagcggcggcagaacgacgagctacggctattttgaaaaagatgatttggaagaagccgtgaattgggtgagacacaaaacgggagacggcggtcaaatcggcatccacggggaatcgatgggagcggtgacggccttattatacgcgggcgggcatcaggatgaaaaaggcgctgatttttatattgcggactgtccgttcgcaagctttcgcgatcagctcgcctacagactgaagcgggagttccggctgcctccgtggccgcttctgcctttggctgatttctttttgcggatgagagaaggataccgtatccgtgatgtatcgcctctatcggttatcagccgaccggcagcccgtgctgtttattcacagtaaggaagatgattatatacctcccgcttcttccgaattgctgcaccgcagaaaacgcggaccgaagatgctctatctggccgaatcgggcgggcatgccatgtcgtacaccaaaaatccggagagctaccgcaaagccgttcaaacctttttagataccatgacgcaaacgtaaaaaagcgaaagaacgtatgctggttctttcgctttcccgtcataaaacgtcggtaatcccgtccatattttctccgatccagtcaatggcgaggtcgattgtcgtaaactcctgcgctttgaaggtcatctcatcctgaagcagccagacatccttctgaacggattcagcgcctccgatggaccagtgcagcagactgtacgggtggttgttgttcagaaaggatacccacgttttatgctgtgccgtctgtttaatggctttcagcttttgattcactttccgtttctccctgctttactaatatgctcattctcgggctcagcatctctgccgggctttttaagacgagcgtttttgccttttcattgtaatcgattgtcatttcctcgtcaaaaaacactttttgtgaggtctggatgtaaagcggaagtccgttggtttcaatggcttcgcattgtcccgttaattcgtccgccagccagatggtcggcacgccgctcaccgcgcacccgcagccttctgcgtcatagcggagctgcgcttttttccccgggttggcgtccatcgcctgctgaagtgtgtgtttcgccgcatccgtcacatgtatttgcatagatgatcctccgtttttcattttcgccattgtagcataccgagccgctgtatgcattgtttctgctttctttacagaagcccgctctcccagtcctttgcctcttgttcagccgccttgatccagtcatttttcccttcactatactttgccgtatcgtacgggtatgccttagcgagccgccgtttcagttccatgtattgagccgctttttcaggcttttcagtgaggtaatcccggaacagcagatggcgcttcacatccggatggcctgtttcgtatatgtggacgtggtgtgtgcgcttgctgccgcctttttgaaagaaacgccggccctctatcccgttttccccttgcgcctcatagccgagtgcttccagctgcgggctgaatcggtcagcatctgaaatatctttgacctccgccagtatatcgataacgggttttgcggccattcccgggatggaggtgctgccgatatggctgacagaatgaagtgcggggccgaagattcggatcaagtccgccttctctctttcaaacatctctttccattccggcttgtacggaacaacttccgctttcctcttcggataaagatgaaaaaacgagagggtcagcccttccggcgtctctgtctgtccggcttctgtgaagccggtttttaaatagagagagactgccggaacgttttgactggcggtagccgcctctattttttgggcgtcccggttttggtcgatcacaaattgaataagcgcccgtccgattcctttccgaaagccggacgggtgcaccgtcagcctgcatatgacaaggtcatatccttttttttcatacgaaatgacgcctgcaagccgatctttttctctgaaaccggcaaacgtctcccgtgaccgctgtatgtcaccgggtgtttcatgcagggctggaatgccgaaaaagccgatcagctcggcttctttttgataagagcagcgttgaaccgccgcaatttcccgcgccgtctgttcttgtgtatgccgtaaaaatgtaatcaatcttccgccccttttgacgcaaacatccgctgtgactccgtcttcgtaatgcggaccgcgtacgcttcataccaggcgctttttcctttttgttttgccgcccggtggtcagtatggtctttccaccttttaatcgcctccaggctgtcccagtaggaaaccgtgatgccgcagccgttttcctcccgaacgctttccgcgcctaaaaagcccggctgtccgcctgccaaattcatcatgcgctctgccgtatgctcatattcctcatcatattttccctttattgatgaaaaaatgaccgcataatagggcggtttgggcgtgtcagctaaaaaacccatattcatccccctctacatatatttcacaaacagaattctgtcttctcccggaccgtcataattcgcaaaaacagggattccgtttacggttttggttcctttttcaacttcaaagcctaattttgtatgataagcgattgatactttattcacgggcgccgtcacgcaattgacttttgtgcagcccctttttttcaccgtctccataaatcgatcgtagagctgttttccaatttgcatttttctgaaatccggatgcacaccggaaaaatgaatgtaggctgtctcagggtctgattgtgactgaaaaccgattaaaaaaccggtcattccctccggcccgtacgtgataaagctcgtgtcctgaaaatgttcaaaaaacaagcgcggcagtttgtctttcatctgcctgccgccccaccattcattcaaaacagacgtaaccatttcatagtcttcagaggtaattgttcgaatatccattatcgattgactctccttttcgtccggcaaaatgaatgtcagctcttctcattggaatataaaaaattatatgtgggttgtttgcaattgtaaatgatttcttttcaagcaaacgaatcagcacgtcttccagccggggaatgatttaccagtataaacgtgatcattgttcgggtacaatgaaaaacagaacaaacgttcccggaggtttttttatggctgatattcttcttgttgatatgcaatcgttttatgcgtctgtggaaaaagcggaagcgcctcatctcaaaagccggcccgtgattgtctcgggagatcccgaaagacgcagcggcgtcgtgcttgcggcttgtccgctcgccaaacgatacggcgtaaaaaatgccgaacggctgtgggaagcgcaggccaaatgtcccgacgccgttattgtccgtccgcggatgcagcagtatattgatgtatccgtcatgattaccgaactgtttgaacggtataccgatcttgtagaaccctactccatcgatgagcagtttctcgacgtgaccggaagcaggcggctgttcggtgatccttttacaattgccgaaagcattcagcaagcgattatgcgtgaattcggaatttatgcccgtgtcggcatcgggccgaataaggcgctcgcgaaaatggcttgcgaccattttgccaaaaaaaacgcatccggcatccacagattggatatgtcaaatatcagggaggatctgtggccgctgccggtcggaaaattattcggcatcggaaaacggatggagcatcatttaagacggatgggcatcagcacaatcggcgggcttgccgggcaccccgccgaactgctgaaaaaacgctggggcattaacggcgaattgcttcagcggacagcccgcggcatcgatccctctccggtcaccgtcaacacgcacagccggcaaaaagcgatcggccataacatgaccctcccgagagactacagccgctttgaggatatcaaagtcgtgctgttggagttaagcgaagaagtggcccgccgcgcccgtttcaaacaatacatcggccatacggtttcggtcagcatcagaggcgctgattttgaattcccttcaggttttcacagacagagaaagctggtctctccgactaatttcggaatggatatttttaaagcggcggtcaagctcttcaaagagcattggaacggtgagcccgtccgcagcgccggcgtctccctttcccagctggagccctgtgattatgttcagctgagcctgtttgatgctcaggaaaaaaagatcagtctcggcaaagtattggatgatattcatgagcggtacggccctgcgtcgctcctccatgccgcttcgctgacagaggccggccaagcctttcaccgggctgaaaaaatcggcgggcattacaaataattgaggtgatatacatgaatccgaacaaattaacacccgggtataatgtcatgtgggaatcaagccggatgatgctgcccgaacatcgggagcagctgcttgcaaaaaaacgaaaagaacgggaattccggcctccggaactgagcgcagagcaactgaacgacatgaaccgcatcattgcggcgtcgattgaagaagacagagccatctcggtcacctatgcttcagcacgcggcccccgccgcttttggggatgggtgaaacaagtgaggcatgacgaaaaacgtttaaaaatcataaacgatgaagatgcgttaacgctgccgtttcatcttattctctcggctgaactggaataaaagcctaaatcgtcctgacagaaaatatgatagaagagtgggaggatcacatgatatttagtagaataaagatgaatgacaagaataggagaatatatgatggatcaatttatagaaaaaatgctgggacaagccctccgccagtatggacggaatgtgtcgacagatccgctgagcccctatgaaaaacagagtttaaaaaaagctttagaagaaagaaggaatgaagaacccgatgaggatctccatgcccatgtagaagatattatctacgattacgtcaccaatcaggggcagttttcctgacacggacgtttatgcaccgggcgaaaagggaaacgtccgagagtaaaccctaaagattgcgtggtgcaggatatgcctgtcgggccttatttcaagatcggctatgccgttcttctgttatttctcatcatttatctcggaacattaatagactttttgttccagcctgttgtgattacggttaaaaccttgtttccgcccattgtattatcgggtgtcctttactatttgtgccgcccgctcgtcagagtgctgcatgcgaaattaaagctgccccaaggaatcgcgattttagcgatttatgcgggaacagccggcctttttgtcctcttcctttatacggcgggccctgccgttcaaaaacagtttacagccttcacagaccatattccggagctttccgcaaaagctgaaaattggatcgggcatcttcaggacagcaaatggttttccaggcttcagcatggggattcctttaaaaaattagcggacaaagccgcaaattattccggttcaatcgctgattctctcagcagtctggccggtacggctgccaatgccgccatcaccgcagccattattccgtttgcgctgtattacatgttaaaagaaggaaataaagccccccggcgactgctgcggcttcttccggaaaaacatcaaaaagaaggaaaacaaatcctgcgggatatggatgaagctctcagttcatacatacaaggacagctgctcgtcagtttctgtgtcggcgttctcgtcacaatcggctattttatcatcgggctcgattatccgctcgttctgggcgcgttcgccatggtgacaaatctgattccgtttatcgggccttggatcggcacatttcccggagtcattgtcggattgttcgattcaccgaccgaggcggtgctggtgattacggtcgtcgtcattgtccagcagcttgaaagccagctgatttccccgcaaattatgggacggaagctggacattcacccgctgaccattatttttcttctgcttgccgccggcaaattctcaggaattgccgggatgctgctggccattccgggatatgcggccgcaaaagtgatcataagccatatgcagaaactattcattctcagaaagaaacaaagctaggagagaaatgattcatcccccatgtcttcacatcggttaaaatgaaaaaacggcgggctgaagaagcccgccgcacacggaggtaaaaaagatgaacatcggtgatgtcatttttcaattgatctcatttattgcagccgcatttttcctgtttgccgtgatatacgtattcagaagcttgaagcagcgccgcatacaattggacagaatcgaaaagaaactcgacgcgctgcgcgaagaaaaaaacgagaagttatagttcattcagaagcaggcgcagccagctccacctttatccgatccgggtcctccgtgtatacggcgtaatgcgtgcttccgcctgcatatggatggcggtccctgtaaagcacggggcatcctctggcaagcagcttttccgtcatcccgtcaacctgctctcttgacgcagcatgaaaagccagatggttcagcccgacccggcatctgtggtactccggtgttaaaaaacgctcctctgtctgtacaagcacaacataaaatccggcgtttttccagctgatgccggagtcccaattttgaaactccctataaccgagctcacctaaaaaccatccccaaaaccgggcggaggctttcaagtcagatacatacaattcaatatgatgcatcataatattcgcttcctcctcacatcacacccgccttaccagcacctcttcaactttatggccgtcacctttcctcaaaatcaaatccgatctgaattttgtcggcaggatattttcatacagattcggacggttgacgctctcccagatggaggcggccatggtatccgcttctgcatcagacaaatccttaaatttatgaaaataagaagccggatcttgaaaagcggtttctcttaagaggcggaaacgctccaaataccacgtgaaaatccggctttcttcggcatccacatagatcgaaaaatcaaagaaatccgatacaaaaatccgcggatcttccctgtcgtcctctaaggtcggcgactgcaggacattgattccttcgataataacgatatccgcaccttcgacaacctcgacggcaccctcttccctgtcataggtaaggtgggagtatacgggcgcctccactctctctttccctgactttatatcgttcagaaactcaagcagcgctttcacgtcgtaactttccggaaatccctttctggacagaaggtttttcttttttaattccgccgtcggatacaagaaaccgtcggttgtcaccaggctcaccttcggcctgtccggcagacgggaaagaagcttttgcaaaattctcgccgtcgtgcttttgccgacggcgacgctgcccgcgattccgatgataaacgggattttcgctgaatgcggatgtttcagaaacacgttgacatgctgattccgtcttgcggcagacgtgacatgaagatggagcagtcgcacaagcggaatataaatcgtttctacttcttccaccgacaggtagtcattcagcccctctacggccttggcttcttcctccgaaacggcaatggaaagatggccgccgaatccggcccacgactcgcggctgtgctgcgtatacaatgtatgtaagttcaattctttacttttcacaattcacaccaatctctctgtatggctttccgattaaaaaacaaacgcttacaaagattgtaacggaaaaccgcctcactgtctgcccatttttttcacaaatgaggaaccgatccggctgtactcttccatttcctccttgggaaccatgcttccgccggtaccccacacaaggtgcacggcattttccatctcaagcccccgctcttttatataacggttaccggcttcggtctgaacgaacttgacggctccggccataccggcgagtgcagagggttcaaggctcttattctcggccgctcttaattgataaagcagtgaaaaaagcgtgccgtcatcagcggtataacagccgctgagtacaggctccatcagagggccggccagtccggacggccttcctaccgcaagtccgtcggcggctgtttgattatcaaggccgatatcctgcacgctgattccgtcatgcaagccggaaaacagtcctaacagcatacagggtgaatgcgtcggctcaccgaaaaaaatatggacatgcccgccatagatcagctttagcgcaagcgcgacgccgcccgggcctcctccgaccccgcacggcaaataaacgaaaagcggttcatctgcacccggctttatgttcatttgatcgagctgctttttcacacggcttcccgcaacggcataccccagaaacagatcccgggaatgctcatcatcaataaaataacaataagggtcctgcttcgcctgcatgcgcccctctttgacagccagactgtagtctgcttcatattcgatgacgcgaacccccttttcccggagcagctcctttttccactgctttgcgtcactggacatatgaacggtcacacaaaagccgagcttcgcgccgattatgccgatactcagacctaaattgcccgtagaaccgacggctatagagtattttgagaaaaaagcggtaaaccgttcctcagtcaatatgctgtaatcatcgtctgttgagagcattcccgcttttaaagcgagatcttcagcatgcttcagcacttcataaatcccgccgcgcgctttaatagaaccggaaatcggaagttcattgtcgcatttcaaaagcagacgcccggggaaagcctgagcggcgctttgttccagacgctttttcatttcattgatgaagacaagcggagactcaatgaggcctcccgccgcttccgtctccggaaaagccgacgcgatataaggcgcaaaccggcgcagcctttcttccgcttcggcaatctcctttctccattcagcgccattctttactggatcatcggttttatgcgggttgatccaaaatacttcacgcgcctctgccatttgcctgactaaaggctctgtcatcaatgccttgtgtatatccaggtcggacattcctttctcccccttgttactttttctttaatgcgcggccggccagtttttctgtaaacgaagggaaaagctgatacagcttcgtcccgaggctcatccatcgcggaagattcatttcccgtttatccgtcagaattacggatgtaatacgctctgccacatggtcggcatcaagcatccatctgccgacgcttttcacataaccgccctctttatctgcaattgtaaagaagtctgttttgatcggaccgggattaaccgttgtcacggctacacccgtaccggccagctcaagccgcagcgcattggaataccctaaaacggcgtgtttcgtagcggaataaaggcttgatttcggcgtcgccaatttgccggcctgtgaggcgatattgataatatggccgcttttcgcatgaagcatcaccggaagacaggccttcgtacaggcgattaatccgaagacgttcacttcaaacattgccttcatatcctccaaagatgaatcagcggctgtttcaaaaataccgaagccggcgttgttgattaatacgtcaacatgaccgatcaaacgccttacgttttcagcctcttctgcatgccggacgtcaaacggaatgacatcacactgtccgccgcgcgcggtaatcgtttttttcacttcctgcaagcggtcctcccgcctggcggataaaaaaacatgagccccttctgccgcgcaggaatatgcaagccgttctccgagtccgccggatgctccggtgatccaaatccgcttatccgttaatctgcccatttccttcaccccttcacagctttaaacatcagagtatttcccgactgaaaggattcagcctccccttttgcagccagtacgtcaagatggccgatcgtttctgacatcattaaaaacaattcattttcatacacagccggaaacagccgccggcatacctggaaagccgtcagcgtttcctctgacaacaggcgcagcacatattccgaccggtttctctgtttttcaagccgcctgtcaaaagcaggctttacgtccgtcagcagatcgccgtgtcccggatataaaagggacgggtttacgtcatacagccgcttcattgagttcaagtagtcgagcatcggggccgcgcgcacgccccccttttccggagcttccagaatcggattggtggagctgttggacaaaagcagatcgccgctgaacatttcaccgcttttttcatggtagagcgcaatgtgagaagcggcatgacccgggatttcgagcaccgtccagccgttaagcccgtcgattttcccgccttcttccactgttttcgttaacagacggtttgcagaaaataagtacgacagcttaactgttttctgtatgtcttcaggcgtcaggggaacgcccatttcagtcataagcgacagaaaaaagtcctcctgccgggcgatatacgactgatcctgagtaatgtacctgtcattcagcggatgcccgatcacttccgtatcctcggaaaaaaggtgcagcagacctgaatgatctgcgtgatgatgagtgagcaccacctgttctatatccgccgcagaaacgccgtgttccttaagctgaaatgagagcgattcagccgcttcctttgtattcgggccgcagtcaataagggttaaggcttcatcttttattaaataaacgataacgtcgccgactgcaaacggagtcggcacacgtatcggaatgatctttctcgctgccatgtttacgctccttcgttcttttcattcctgaataatcatattttagcgttttcttttcactgtgtcattattgcgcatatcggaaaaaaagattgacatcccgctctttcgcatagcataatgaacaacaaactagaaaacacggaacgcgatgacgaggaactagtatataaacaacggcagcagagagcaatgtccccggctgaaagacattgcggccctcttgtttacagaacctgccctcagagcggttaggaaaacctaaacgtatccctcgttacgggatttgagctgagcacggctgattcgtgctaatgtaaggtggtaccgcgaaaccttttcgtcctttttgacgggaaggtttttttgtgttttagaagaaggaggatttatatgaagaaaatcggttttatcggggccggatcaatggcggaagcaatggtgaacggactgctgcaaagcggaatgacagcccccggacatatatatatgacaaaccggtcaaatgacagccggcttgaagagctccaaaaaacgtacggagtgaaaccgtgccgggataaagaagagtttttcagcaataccgacattattgttctcgcctttaaaccgaaagatgcggcagaaagcattgagaacattcgcgaatacgtgaaagatcagcttgtgatttctgtcatcgcggggctgacgattcacacgattcagcaatatttcggcagaaagctcaccatcatccgggcgatgccgaatacatccgcggccattcagcaatcggcgaccggtttttccgcaagctccgaggcgagtgaagctgaaatccggacggcaaaagagcttctggaaacaatcggagaagcgacgctctttgaagaaaaacaccttgatgccgtcacagccattgccggaagcggtcccgcctatgtgtaccggtatgtggaagcgatggaaaaggccgcccttcaagccggcctgccggaagaaacggcaaaagagctgattttacaaaccatggccggggcgacggaaatgctcagaacaagcagcaaacggcctgaacgcctgcgtaaggaaatcacaagcccgggcggcacgactgaagcaggccttcgcgcattagacgagcgccgctttgaagaagccatcatgcactgcatcgcagaaaccgcagcccggagcgccgaaattaaagaacaattcgcaggctccgttctgcaaaagacggaccagtcataaagcatgggggcatcccatgcttttttcattctgtttaactgccgtataagcggctgattctctcttttacttcaggaagatggaatgtggcttcgtgcatgtttacctcttcctcaaccgcttttgtcagctctcttttgatccgtgcggtcacattggttttcagcgcaaccagtgaggctctcggtttatccgccagcagccgggccaattcgcggcctctttgaagggcgtcttttttcggcagcacttcaaacggaacaccccgtttttccagagcggcgccgctgaaattcgcggccgtaaacagcatttcttccccgaggacaattcccagtttttcaggcacaatatacgtcgcgcccattcccggtgtaaatccgtacttcatataattacaagaataaaaactctctctgcttaaaatgacgaaatccgagctcagaccgatcgtaaagccagctccgatggcatgcccctgcatgacggaaatcacagggatcctgcaatccaataaaagactgtgaagctttaaatctgtaaattgaagctttccgctctgaatggtcaaaagcccctcctgcgttcctcccgtgcagaaataatttccgtaacccgtcagaaggacagttttataggacggatgggcattgatgtcttggaatacccggtgcagctctcttacaaactcttctgacagcccgtttttcccggccgtatcctgcattgtgacctgcacaatgcccggttctgtttcctgtacatcaatcattggattcatgtgtattctccgtttctttaaaaatactcaagcctttccggctcttatactaggtcgtccattcatactttctgtgaaactcttttatttcagtcagcactaatcgcgtttttccttgatgcgcattcgggatgtctgctgcgggcgcggcatttcttgtgccgaattttacgatgccgctgtcttggagcagccggtcataatcagtcatcgataaacggacgcgtccatccaaatgccggctgatctgaaattgattctgccgcgcacggctttgcggcataacgacaccgctgtaaaattcagagcagcagcccgaaccgtatgaaaaacagccgacgcgtttcggcgtttcaaaagagccgttatcaatcgtgctggcaagagataaaaatacggtggcccccatgatgttgccgacgcgctgacagtattgaatcccaggcagcacgcgttgctgaaaatccgcttcaatgtcctgcggcttagcctttgccaattttctcatcatcgtccgatgcgctccttttaccattccgccaaacggagtatgaaaagaaaggtattgaaatgtattcttataatccgccccgctcacacgctttcggtattcctgaaatgaattttcacagcaatccaaataagacatgagcgacagatcagcatcccccgcttcactatccggaatcgggcggcaggtatccatgacttcatacccgtaatacccgcttgcaccttgatcaagcaaaaagacatgaggagtgctgctgactaaaagcgcgacagctcccgcccccgcactcggttcggcataggaccattcctccgtcaacgcgtcaccgccttcagccactaaaaagcgggaaatatccgttccgatgatgagcgctttcgctcccggcgatgtttgcgacaagatgaaattcacgcccatttgaaacccggccgttaaagaatagcaagcctgcttcacctcaaataaccggcaattccgcttcagctgcaaataatcatggacatatgtactgatggatttgccaaaatcaatcccggattccgtacaggtaatgaccatttcaatctgattccgttcctcttctgacagagaatcgataatcggttttgcggcatttacggcgaacgtaatcggatcttcaaacggaagcgccaccactttttctttcatcagcaggttctcaaacctttttttatccaggttccgatgttccgcaagctccatgacgtctacatacgcggttccgccaaacacgttcattgcttcgattcctacattcatttctccaagcccccagagtaaagaggcttcccgcgaagcctcttttattttttcgttcaaaactcaacaagcagcctgtcaacgccgtgaaatacagggctcggaaccagattcggctcttgatcctcagtaaaacgccatgcgggcatctgttcaaaaaagtgggaaagcgcgattttcgcttcaagccgggccagcggcgctcctaagcaataatggctgccctgaccgaatgacaggtgctgattcggctttcgtcccaagtcaatctgatcggcattttcaaacttcttttcatctctgttcgccgatccaatccacgcatatactttttctccggccggaatcgtttttccgccaatctcgctctcaaccgcggtgtagcgggttacccgctgaatggaaggtctgaggcggatgacttcctcaataaagtcaggaaggagcgccttattttcaagcagccggggcagaatatgcgggaactccttgagactgagaaatgaatttccgatcacattttccgtcgttacgtgccccgcgacgatcaacaagccgcaaaaaccgattaattgcttgtctgacagcggctctccgtctaaatcagctgaaattaaatggctgattaaatcattttgcggctgttttctccgctgtaaaataaactgcataaagtatccgatcatctgcttttgcacttcattcattttcttttcatcttttacattctggctttggtcgacccagcttttaaagatatccctgtctttcggaggaaatcctaaaagctctgcgatcacgataatcggaagcggaaatgcgtaatcttcaataatgtccatcctgccttttgaacggacggcctgaagcaggtcatcagcgatagcggctatacgcggtgcaagagactcaaccgatttcggcatgaacggctgattgaccaattttctgaagacggtgtgttcaggcgggtccattttcaaaaggctgtctttgttaatatgccggatcattttttcctgcttgtccgcacttaagtatttatgatcggaagaaaaatgactgtagtcagaaatcacccgcttcacttcatcataggtgaagatttcccagcaatcttccttttcattgtaatgaacgggagaggtttctctcatcgtttggtaccacttgtacggctgctgctgtctgatttttgttaaactggtcattttcattcctccaagatgtgtccaagatttgaaatgacccgccaaagcttacgagtaaacccggcgggcggatatgtgaatttacggtcttattttggcgggctgcttcagcatctcaccatgcacgttcagtatcttttcctgcagtttcagaaagctgtgttctgtcattccgtctgccgaatataaaacgccgcaaaattcagaaatcgtttcggctgcgctgtcttcagccaataacgtcatatggttggataccgccacatccatgatggcgatgtttgtcatatgctcttgccactggctccagtagttgacgaaatcagcggataaaatatcggccctgatcgtaaaatacggatcaagctcacccaagaaaataccgtttttatttcggaaataatagcatgtcaccccgttcggatccggaagcggcaggagttcgtaatcagtgatttcgtaagcgtcctgaacgtttatattctgcctgatcagatttttcaccaacgcgtccgtcttcgttaacccccgctgtttggcttttgctattaattgctctaaaaatatgtcttcatgaagatcggcatctagttcatcacggtgaatcaaggtttcagaaatgcgttccggatgttgatagatcggtgcaaataaagccatgttcaccgtctgcagcatcatatttttatcaaataattcatcaggaatgtttatttcccgcgcacccgccgagtcaaaggagtcgagcatgacgattgactcaacggtttctccagccagctgcaattgccgggtgacttcataagcgagcatgccccctaatgaatagccgcctacatcgtaaggaccccggggctgcacggtacgtatgagcttaacgtaatattccgccatgtttttaatgccgcggatcggttcccggtctgtcatccatcctcttgcctgaattccgtaaaaaggacgcccggtccgttcggcaacaggctggtacagctccactgcccccagcgcggaatgaaaccagaaaatcggtcttccctttccccccgggttaagacagatcagttcgggcggttcttgatcatctgtctcttctgatatatcgttttgtttcgtatgttcctcatgtacttcatcagtgtctttttgaacggaaccggtcagatacccggctaattttgcgattgtcggatattcatagaccagatttgccgtaatagacgcttgatacgttttattaatagactgaacccattccacaccgataatagaatccagccccatgtcaatgaatgcctcatgctcatcaatatcttccggcttcagaaacaggatgtccgcaaggctttctttaagctctttgcgcaaagtgccgtcagagatgccggcaaggggagtttctgcttccgggatttgcggacgtaccgctgtttcctccgcttcagcatactcgggtttctttatttgccccgctatatattccgcaagctcctcaagcgtcgggtgttcatacaccttattggcagtaatctcagtgtggtacgttttatttactgtttgtatccattcaaccccgataatggagtcaagccccatgtcgatgaaaggctcatcagcatcaatatcttccggcgacaaaaataaaatatctgccaggcttatcctcaattcttcaagcaatgttctattgtcttcggaaacggcgttttccggctgctggacaggaacagtacaatccaaaggctgtaagacgatcggtttttgcaatgtctccggttcaaacgctgtcatttcgatctcagttaaaggactcagagaaatcagaccttcatgttcaggctgtggcggagacgggggaacggtttgcgtttcagactttttcatggcttggcctggtaaagaactgtttacatcagccgcccaatacctttcttttaaaaacggataggcaggaagcggcgttttataatattgccctccgtcaaaaagccgtgtgaaaggaagatcatatcctctgcaaaaaaggtcagcgatatgtgccaggctttctctgtactgtgcgggtgaagccgccgagcagcactgttcaatgcattccattccgaatgttttcattccggcttcgtctgccggcttctggtccttcaaattggacacaaacacacccggaagctctctttttacaagccactccgataatacccgcttcagttcgtccgcactgcttacgatacaggcaaaccggtgatgcagatgctttctgccgagcaggagcgtataacttatatttcccagatcgctgtctttgttcttgctgagtgaatccagcaggcgttctgcctgaatttccagctgacgctccgtccgcgcagataaaggaatgaggcaggccggttttgccggtgaccggcgcacggtttgcggcgcctcttcaataacaagatgggcatttgttccgctgaatccgaatgaactgatcgcggctctgcgcggtgcatccggattccgttcccacggtatcagcttttcattcacaaaaaacgggctgtccgcaaattgaatatgctgattggcttgatgaaaatgcagggaagccggaatctgccgatgcttcagcgacagcaggattttaaacaatccggccatccccgcggccgcagcggcatgtccgagattggttttcacagagccgatggcgcaatatccttttttatccgtatagcggcggaaagcgcgcgttaaggcgctgaattcgatcgggtcgcccagtgcagtgcccgttccgtgagcttccaccatttgaatggtttccggattaatgtgaaaagtatcatagacatgccgttccaatcgttcttgagaaagcgcgcttggagcggttattccgtttgtagcgccgtcctgattcattgcagagccttttatgacgccgtacacatgatctccgtcactgacggcgtcgctaagacgtttcagcaccaccgctcccacgccttcacccggcacgaagccgtccgcgctttgatcaaacgtatggcagcgcccggtcggtgacagcatattcgccttatttgacgactgataaaaagcgggagtggattgaatgaaaaccccgcccgccaccgccatttcggtttctttcgtccagagcccctgacatgccaaatgaatggctgtcagcgaactggaacatgctgtatcaacagtgatcgccggcccttgtaaattaaggtgataggcgatccttgccggagtgacggaattgtgattgccccaaaaagcctgcgcgggcccctgctgtttaaaaatggcctggtaatctccgccgcaggagccggcatacacgccgcattcccggcctcttaccgagtctcccgcatatcccgcatcttcaagcgctttccatgattcttccagaaacagcctctgctgcgggtccatataggttgcttcacgtcccgatatatgaaagaaaacgggatcaaaacattcaatgccctctataaaactgccatactggcattgactgtcagagacagcccatctgtctgcttttttaatcagatcccgtccggcggctaagttttcccaaaactcatggacattctccgattcagcaaaccgcccgctcatcccgataatcgcgatcggttctttttcaggtaacacagctgctgattttaccgtttcggccggatccttttgttcggggcggtacgtcatttgatacggctcagaaacgctgatgacgattttcccgatatttccgcggtcatccagacagtgatacgcttcttttatgtcttcaaaggaaaagatttttgagatgacaggctgaatgactccctcttccgccagccgctgcagttccaattgatagtccttgacctgatccggattttgaagagacagcttccgcaaatccacgctgtgaaacgattgattgttatgaaggacggacaagtcgactgatttagcggatttcagcgcagtcatggcaatttcgatatatcttccgcccggcgccaggcaattcattcctttttgcatggcatcaccggccagggtattaatgacaacatccaccccacggccgccggtcattcgcatgatttccgtttcaaaatcttcttccaaatagcaaatggtattgttgatcccgagcgaatgcagatactcaatttttttctgtgatccggccgttgcatatatttccgcgccgatatgccgggccatttgcaccgcgatcagccccgttcctcccgtcgcggtctgaattaatattttttcgccttttttaagtccggctttccggaaggcgtctatcattgtcactgccacggtaggaagagcgcatgcttcttcaaaggtcagccgggccggtttatgatagacttgatgttctttacatgtgatgagattcgcctgagagccaaattcctctcccataccgacaatcacttcatcacccggaatgacggatgttacatgcctccctgtcttgatcacgacgccgcttgcttcgaatcccggagtgaacggataaggcggcatcgtcggatacagccctctgacacaaagcaagtctccgaagttcaaagaaaaggcgcggacggctatttgaacttcgtcatcttttgtctcgggcacttcactgcgggcaatcgtcagatcttcaatgccgcccggacggtcaatcacaacccggaacattcccgagtcatcggactttgcgaaagaaagcggcatccgttcttgtttcggtttctgataaccgttttcctttctatccgtcttcaaaggtttttcagcaggccgttcttcctgaagcaccgggcggattttcgctctttcggtctccagagatgaggctatgatggtttcatattctgccgagatataaccggtcagcagtttcacatgatagtaatcaaataaaatcgttgtctgcagtgtaagattcaatcgcttattaatctcgttaatcacattgacggccaaaatggaatcaataccgtattcagagaaattcagttcttcctgaatatcctcttctttcatttttaatacatcggcaatacttgttttgatgacagagcggacatgggaagcgaccgattccccatcagccttaacagcttgatgctcctctggcgcgcggctgcgggaaacaggctgtgcgggctttcggaaaacttcggccggggcggcgtatggctttctgccgtctctgatcccttgcatccggacgagtccgtcactctcagctgcgataatctgctgacctaaatcatgagccgtttcagcagggaaacaaaccgctctgtatccttccgaatgcagcacacgctcccacgattttggatataggccgggacttcccggaatccgaagctcagcatcctcataggaccaccagccgtcaagcagcccgaaggttaaatgggtaaaaacagaacgatcgctgatttcgtttatcaaaatcatcccgttgtatttcaggagcgctttcagacggcgcagtgtcaaaccgatattttttgtggcgtgaagcacattggcggcgatgacaatatcgtaaacacccgttttgatattttgtgattcgcaaggctcctccgcattaaacaaggctgttgtcaaatacggcacatcaggtccgtattcctgttcggcatgcattaaaaaagctttagaaacatccgtataacaatattccgcaatctgttttgcaaatggtttcagttttgtaaacagcatggcgctcgttccgcccgtcccggcccctacttctatcagcctgatacgggcatcgggatgttctgtaaggtaggctttcaggtaagcggccgcggaatctgctaacacttcattaaaataatccgcaacgggattatgcttataaacaccttcaacgagccgcattgatgaatcgggaaatacgatatccgtagccggacgttctccttttaaaattgaaggcatcgcttttatcgtcgcctcggccaattcagcttgcgcaagctcccccttgggaagcaggcgtttatgggcattccactcattccagactgtgcggccgtccgggcgctgatccgcgagaagagtgatcgtgtatccgtcatacgcgatatatccgttttcttttaatagattcaggctttcttccagccatctgccgtatgtgccgatcacgccggcgctccgcatggatgctgcaggtgtggtgacaggctcgctgaaaaacccgattgactgtaattgataaaagagcagtttgcaaagaaggctgttcatatgcgcaactccatttctcgttttaaagtctcaagccgttcattccgatccggattttgccgcttgacgctttccataaatgaaggctccgggccggatacaaccgatattgcatcttgatccgtcagtgcggctaagccgtgcggagcagctttgatgaatgccgcttggctgaacggttctgatagtaagacttccagcgcctccattgcttcatcgggttcaatagaaccgatccctgacgcctccatccgttttctgtaagacgggtctgatacaacgcccagactgccccaatatccccaattcatgactttcacttcacaatcaagcaaggaagcgatatggcgggcaaaggcgtcttgaaatgtacaccctgccgcatagttgctttgcccggcattttttgtgaaagaattaacggatgagaaaaacagcacaaaatcaagcggttctcccttaaaagcttcgatcattcggacgctcgtattcaccttagctgaaaaagcgtttctgaaagaagcttcatccatattcgccatacttttgtcggcaagcgttatcgcggaatggatgactcccgttatattgccgtatcgctctcttatggaacggacggccgctttaagcgctgcggcatcttgagcatcagcctgtatataatgcggcgcggggcctgatagggccagcctgtctattttgctctgaatctcctgatccttcggccgcctgccgatccatatcatccgtgctttgtaacgggtgatcatgtatttgctccatgcttctccgatgccgcccgctccgccgatgacagcataaacgccgccttctctgtacgacatacgcggagcggaacttgtcagcacccggactgttttttgcttgtgccaagctccgttacggtacgcggcagcatttccgtccggatctggaggaaggcgccagatgtttttcatctcagacgaatcactgccttcttctgcatcaatcagcctgatgtcccagttcggatattcttttgccaatgaaccgatcaaaccgtgtacgcctgcatgctcaggctgcgggagatcacccggatacacggactgtgtctgccgggtgaccgccgtaaagctgatgtttcggtttccatacccgagtgacagcagcgctttgatgaaacggaaacattgaatcaccccattctcctgctcatcaagcatttcctgactggcggatgcgggtgcgaaacgatccggcgcaatccataagaaatggcggatatcttgataaccggctgtcaattcacgtaatgtttgctcgcttgaatgatccggcgtctccgccagatgggcgcggggccacatttttgccgcggcctttatggtatttcccggctttccgatgatcagcaattgttcctgatcaaccgctcgattttcttccagggaaaagaaagttttgtcccaaacaggggcaagcatcgccgtctgaacttcctgccgtttgctttcggtttggtttgtctgccggacagcccggcaggagaagcccgtcaatctcatacaaacagcgccgttttcatcacataaatcaatatccagcgtcagcgctccgttatctgaccgatcgctctgtttgcggacaagcgcccacatcgttttctgagtcggctgaaatatttctgcctgccgcagggaaaacggcagcatcggagtgtctccggcagtatctgaaccggcccccagtgacgcctgaaacgcggcatccagaagactcggatggatgacaaactgatcggcggtactgtctgccgtttccggcagcgacagccgggctgcagcccccctctctccgatcatcagctgatcaatgccttgatggctcggcccgtagatcatacccgcatgccggaaagcctgataaacctcatcagacgtcataaccgattgactgcagccggacagccagccctctaaatgaacagacggaaccgctgctatctctcccgataccgcagtgcctttactgtataaaatccgttctcccccaggttcttccgataggctgtaaatcgtaaattcaatgtcttcattttccttaagaataaggctgatatggacttctacatccgtccctttatgaatgacaggcctcatccatatgagatctttcaaatacattcctttacgtccgtccggcacagcgtatgcggcacgctcaacggccgctctggccatttcgatcacggcggctcccgggagcaccttctgtccattaactgtgtgatcagtgaaaaagaattcccgtccggtaaaaacagaggtgaatttcagctcccaaagatcggatgtgttttcatggagcagcggatggatcaccgttttgccgtcatccctttttgaaaccgcctcggcttcatcttgaatccagcatctgacttttgcaaacggatagacgggaagactgattctccggggtttttgttccgaatataacaagttccagtccacatcgactccctgcacccacattttcagcaaatgaccgtactttctctttttcagccatttaaccatcgcttcctgcaaatcttcatcagattcaaacacagccactgtctcatgatttcgcttcgcccgtcccctgtaaagatgcggtgcgttttcattttccaagtacgatctgagcttgtcctccagctccttaagggagtccgcaatgagagccagccgctcatccatcgcttcgcgccccgcttgtaaagtgtacgcgacatcaaataagtccggcttatcaatatgcttcttttgaagaaaagcaagaaggcgctccgcatattctgtcagacgctcgccatttttcgcagacagcagaatgaccgccggctcttggctgctgattgcttgtttgacaggagcctcatattcttcaataatgatatgcgcgttagaaccgcccgcaccaaagctgctgattcccgccctgagcggctgttcttctccgtctgctgaaatccgtttccaatctgttaattcacggcagacggaaaacggcccttcatcaaattgaatattcggatttaaaacatcagcatgcaaggatggggcgatttgtttgtgcttcatctgcagcagcacttttgtaactgcggcgatgcctgctgccgattccccatgtccgatatttgatttgacagacccgacaagacatgtttcaggaacatcaccgaatgcatcggttaaagcccggatttcaatcggatcgcctaatttcgtccctgtcccgtgcgcttccacatagctgatccggcccggagatacccccgcttcctgtaaagcttgagaaatgacttcgctttgcgccttggggttcgggacggtgtaaccgctcgctctcccgccgtgattaatggcagctcctttaatgacgccgtaaatccgatctccgtcttgtacggcgtcttctaaacgtttaagaagcagcaccccgaccccttctgccggaatatagccgtcacctccggcgccgaaactcccgcagtgtcctttagatgagatgaactgcccctggctcagcatgaagtacttgttaggatgaacggtgagattcactccgccggcaagcgccgcgcgaatccgatgatcccgcagatcccggcacgccatgtacaatgaagtcagcgaacccgaacacatcgtatcgaccgaaatgctcggcccttgaaagtcacaaaaataggagacacggttagcaatggatgaaatcccgccggggagcccgatatgccgtcctttcactcccgcttcagccgcgaatagcgggtattcctgatacatgacaccggcatacacgcctacctgacgccccagttcaggtgatgtcctcgtatatcccgcatcctccatggccatccaagcatgcattaaaaacagccgctcctggggatcaaggtgttccgcttcccggggggaaatcttaaaaaactcaggatcaaaatcggcgatcccgtcaatgaacccgccccatttgctgtagatcgctcccggcgccgtacggtcctcggaaaagtaatgttcccatttccagcgatctttcggaatttcggtaatacaatccttgccttgtttgagattatcccaaaacgcatcgatatcatcggcctgcggatacttgccggaaatcccgacaatggcaatatccagcggttttcctttcgtttcctgacggctttgattcccggacggggcaaaagacgcattttcaagccgatttggctgaagcacttctttcacagacgcatttttcaattccgccagctgttccccggtatgactgaggattgcggcatcaaatgagagaaacccgtcttttttatgtttgattgtattcaccacatagacggtatcagacatgacaggtccgtaaagcgtcagcctctcaatcatgagcgggacgtgaatccgctttttcagctgcaattcttcttcaccgagcgacatataacatgaattcaatataagcgggtcaaatgcaaagtgatgcagatcgcctttttctttttttcctgataagtccagctgcaataaaaaggagctctcactcattttgtatcccgctgttaccgttttcagcatcgggcctatcgtgaagtcggcaaccgaatcgtacagacgggaaatgacatccggcgccaccttttgtgcatgcgacttcatttgctcaacgtcatatgatttttttatgggtgcctctgtatatctgcttatttctccttccgcacatgtcttccggctttctttaccggagacagtgcagcttgctgtaaagcgttcggcactcttttctgccgcaaatgaaatgtcaatctgcgcggcctctccaggctccagcgtgacgggcccgcccgtaaagcggatatctttcagctcggcgggacacgtgccggaatgagacgctccggatgcttcaagcaccagacacggatacactacacccatcagtgccggtttgccgaaaaccagatgatcctgaaggaatgcttcatgttcatagaaagtaaatgtctgactgcctgattgtgtttcagagaccggtgctgcatctgcgacaaggctggaagattcatctgttccttttgtttttatgtcttcgagcagttcggatatgctgctgcactcaaataaaagagtcggattcagacgcagatcaaacgccccttcgatgtctttaataatagccagaagctgtgacgattcaagacctaattcaaaaaacacggtgtgcgcatcatttcttgtgactgaacggcctacgtatgtcgagaaaatgcggtataaggtttcctccatctgctgaacgcctggtatcagctgccggtcaaaccgcacctttttggctgtcaggccgagcagtgaagcaatatgcgcaccgctgaggttgtaaaagtcaatatccattttcaccatttcagaaggcgtgccggactttttcgaaatcaccgcgtaacagcgctccgtaacagtctcagcggcaataaacgactcataataaatcggtaaaaataactcggcgcctgcagctgtctgcaatacgccggaggccatggcggcaccgtccatcagcgcgggatgaaagagagcgccggggagattttcccggcatgaatcagactgccgaatatcaaggaaacatgcctcttcataagcatagatctctccctccggcttcatcagcccgtcatgcgacagtccgcggcttctcgcggcttcgtaaaccgcatgcaaggagactgatggaagtgcggcttgttgttttttctcccctgcgtcaagacgcctgtctgatgagaagacttcttcatgcatctccgctgataagaaaaccgtcccggaatccgcctcgcaaatcgaggcagtccagaactccttttctttactgaatatgacactcacatcaagccgctctgaccgcttcactgataaaggatgataaatggtcacccgtttcagacagatggaacggaatgaaagatcaaggctttgctttgccagctgatacagcatatcaatataggccagaccgggcatgacagattctccgtgaacaagatggtttttcataatgggatgctctgccgtcaggcgcagattcactgtttttttcatggttagtccccttttaaaaacgtcacgttgtcacctgccaaaacgagtctgcaggtgcagtgcttgtctctgcttttttctcatatttctttaaaagatccgcaatgtccgttttttcattacttgttttttccggttcactttccgtgctgttccagccgcccaagagcgggtagtgtttttttctgaattccggcggctgaggcgaccggtgatgttcccgctgtctttcacctctgtattcttcaacgaggatatgagcatttgtcccgccgtcaggaaatgaactctgagctgcgacgcggggtttcttctctgaatgccaatcaacgggttcacgattaaaatgaatacgcgacgcttcaaagtcataatgttcaaatgggtcacgcgctgataagaaaggcggaatccgcttatgatagacgctcagcacacatcggatgaagcccgcaagacctgaagacagaagcaaatgccctacattcggtttcaccgatccgatccggcagggcagaagcgttttccggttcagctgatagacatctgagagcgccttgatttccaccgaatcaacgattggggaaccgcctccgttcacttctatatatccgatgtcttcaggcgacttttccgccatattaagcgcagtttgaatgacatctctctgcgctcttatattcggtgaaccgggaccgagcgtccggccgtcattgtttaccgagacggcttttatgacgccgtaaatgcggtctccgtcccgcaccgcatcgctcaatcgcttgataaaaaccgcccccgctccttctccgagcacttctcccgctgattcacggtcgaatatatgaaacacgccgttctcatttaaaatatggcgcgctccgaataaccggtgcgcggacggagataagagcagactcaccgaaccgactaaggccgcgtcaatccttccggccaaaagggcgtcttttgcaaaggacagcccgatcagccctgaggaacatgctgtatccacgacaaggctcggccctgtgacattcaaaaatcgtgaaatgttggccgccaaatagttttgccccgcccccaaaatcgggttaggcgcctgcaggatatgttccataccggctgaaggctgcgccctgccgccgatgtacacgccgactttccggcccgacaaatccttttggccgtacccggcatcataaacggaatgaaccgcttcttctaatatgatccgcgcctgcgggtccataattgccgcgtctttttcagagatgccgaaaaagcccgcatcaaacatgtcgatatcatcaatccaccccgcataatcctttgcatttgctgttgcatgccagcgcgatgcggggacaggccggatggcagtattccctttcatcagcagctcccaaaaagcatccgttccgcccgcccccggaaaacggcaggagatgccgacgacggcaatatcgtcttcggtatccgctttcggcttcatggatgttctctcttcagcggcggcggttacatcaggctgaacgtccccgtcttgaacgaaaccattttcttttgtcacaaaatcggcttcatgatgcgctgcgaaatagtcaaccatttctgtaatcgtttgatattgaagcattaaggacggtgttaacttgatgctgatccgtttttgcaatgattgaaccaattccgcaaagagtattgagtcaatcccgtattcatcaaacggcatatcatcttttatctgctcatccgtcattttcagttcttcgctgaaaacggtgcgcacccattgacgaatcatatccttcaccttttggtcaccggcactgctttttttcatgggagcttcagttttcttcaccttcagaagatcaccaaaatcagccttactgtcttcgggaacacaaggaattccgcagctttgtccgtttaatatgatgtaatctaaaaacttcagtccgtcttcggcagacagcctggaaagtcctgatttttgataagcaggtgtttccggcaggccttcagccatgccggtttctttccagacgggccattgaacggctttaacaaacacgtttcctttgcctgcctgatgatttgcaaaagagtccataaatgaattagccatcgcgtagtcactttgccccgcagcaagcgaagggatcagacccgaaacggatgagaacaaaataaaaaacgacagcggctcattccgaacggcttcatagagaccgccaagccctgttactttcggcgtgcaaacgctttcgatctcagtttcggttttgttataaaaagcggggtgttctcccattgcacccgcgcaatgaaaaacaccggtaatcggtcccattgtgccgcggatgctgtccgtcatgttccggagccccttttgatccgtaagagaaacgctgtaataacggatctccgcgccccgctcggctaacctctgcatccgctcggctttttccgggagaatgccgtcctttttcatgtcttcccactccgaggaatcgggaagcggctcccgccccatgatgaccagttttctgcacccgcgtgaaacggcatgctccgccgcaattgcgccgatcccgcgcgatccgcccgttattaacagcacatcatcagacgaataggaaagctcaggcaccgcagacacattcgtacccggcttcagaaacggcacataacggcgattcagcctgtagcagcattcactgccgcttttggcccgcggctgtaaaaattcagtttcaatctgtctgcttaattcttctgtatgctcaatcgcacaatcgctatctatcgtaaaagaatgaatgttggcatactcagcgcccagcatccggtacagccccgccgttttcgccccctgcatcagaggtttactttccttgaaaggctggaggcggtgtgtcacttggctgagcacagcgccgctatgacggaatgattccagaacctgctgtaaaaaggcaagctttccgtattctatctcttcccgccgttcatattccgcatcatatgcggttatgtcgacgaccccgagtatctgtttgttttgaagagactcccgcactctgccgtaaaggtttcgccccgatgcggcagcgtaataatcggcgccgtcttttgcctgatggatgaaacagatcgtttcaatatggccgtttcctttaaatagagcatcggccaatcggctcgtcttatcagttgcaagtatcattactgttcctgataatgcttcagactccgccggatcttgctgcttccagtctttttgaagaatgatcttttggttttccgccggttcgtctgtctgtttccggatatccgcaggcacaggcacccaataccgctccttcgcgaacggatatacaggaaggctgacccgtttcggcttctctccttcgtataactggctccagtcaacggcggctccttttgcccactccgtgagcaatctggaatattgcttgtttttcaaaagctcggccattccacttgttgaaataacatcttgagcacgtccgcggaaacacccttcaatttccgttttccgttcaagcacatccttcagtttcgcttgcaggccgcaaacggatgtaacgatcaatgccagccgttcaggcatcgcttctctgcccgcttgaagcgtgtaggccaggtctttaagattgacttctttttcccgtaaaaagcggtcataccgtttgacatattccaatagccgttcttcattttttgccgaaagcagaaacagaaccggctcgtcttcccgtatactcagcgatttcttttcagcctgcggcggcagatattcttctatgacaaaatgggcattgctcccgctggcgccaaaagaacttaaacccgctcttctcggctggtcaggatgtgacggccgttcccattcttccagccggtccgccacataaaacggcgtatccggaaatggaatatggggattcagcgtgtccgcgtgcaatgacggaaagatttctccatgcttcagctgcaaaagcacctttgttaatccggcgattccggcggctccttctaaatggccgatatttgatttggcagagccgatggcgcaaaaccgctttttgtttgtccatttgcggaaagcgcggctcagcccttcaatttcaatcggatcacccagagacgtacccgttccgtgagcttcaatatagctcaatgtctccggatcaatgccggcactctgaaaggaatctgtaatgacttccgcctgtgatgccggatcaggcacggtcaaaccggatgtttttccgacatggtttaaagcggagccttttatgacgccatatatcggacagcccatcttttccgcttcttgaacggttgtcagcaacaccgcgccgacgccttctcccggcacatagccgtcaccgccgtcggcgaagcttttgcagacgccttctgaagacagaaatccggcattcgccaaaaacgcatatttatgcggatgtgtgaccgcattaacaccgccggcaatggcgaattcgcactccccccttttaatgctttcacatgccaaatgtatggatgtgagcgaagaagagcacatcgtatcaacagccattgacggccctgtaaagttcaggcagtgagacacgatattcggaacggaggcaggcgtcacgcccatagacagcggtgtgccccgctgtgtgatttcagcgccgaacagctcataatggctccaaaacacacctgcgaataccccgacgcgttttcttttttgtgaagatggcccgcgcgccgttctgtcctgataaaaaccggcatcttcacaagcttcccaagccgtctctaaaaacagccgcgcctgcgggtccatcatttcagcctggcgcggagtcagattgaaaaacagcggatcaaagctgtctatgcgatctaaaaatcctccgtaacagtagaactgatctgcttcatatgagaaaggataacctttccatctgtctttcggcattgttgtgatacagtctttacctgagcgcagattttggtaaaattcatcgatgcttcccgcctgcggatatcttcccgccaatccgattacggcaatatcgtgctcttctgtatgtctctcttgttttcggctccttctcttgacagctgcatgggataatgaagagcggttcttgtctgccatcggaaccaatcgggccatgctttcagttacagcaggctccttcccgtataaaataacggattgcagcttgccgagacgcagcatatattctagtgaagccatcccttccccggccggaagcgggctggtgccggttgcatcattcatgatctctttcatcaaactgtcaacctgcatgccgccatcttcccaaagcggccagttgatcgtcatagaagccccggtccgttcgcctttttccgctttgcaatcgcgatatttcatatattcatccataaaagcgttcgctgcggcataatctgtctggcccgcatttccggtcaacgccgagaatgaggaaaatgcggcgaaaaattcaagcggttcatgccgtgaagcttcgtccgcatgaatcaggccgctgattttcggcaggaacaccctcttcaagtcagtactgtctttttggatgataaattgatcttttaaaacaccggcgcaatgaaaaatgcccgtcagacggccgaaagtttctgtaatctgagcaaatgcccgctctgtttcggctttgctgccgatgtccgcttgaacgtaaagaacttccgctcccaatgctttcagtctgctgatcttctcagactgttccggcgaacgcccgatgagtgcgagcttcaccttttctttttctgcaaggtgacgggcaagcagaaatccaagaccgccgagacctcctgtaatgacatatacgccgttttgtttccaaggagactgtgtctgtccgcccggtttctcaatacgttcgaacaatctgatctgccgcatatcgtctttataccgaatgtctgtgcagcctgcatgagagcagtctgcttctgttctaatgattgcggccgtctcacttggcaatctctcattcttgtcacagaaggtgatcacctgagtgcgaagagccggattttccagatgtgccgttttcagcatagccccgagagcggaagacaatgccgctccattctcaacggcgcatacaagctgaatcaatgtatgttctttcggatggtctgtcagttcccgtttaagcatacgaaatataagctcggcatctgctccaaactgctcatctgcaacctcatgctcccttttcagttctatcacttccgcttccgggcaatgtgtgccgagttcaccggtgagacggggtcctgcatcggcagcaataataagatgacgggtgtgtttttgcccgttctgcaccgccgtttccagcggatgatctttccaggcgggttcaaaaaacagaacctcatcagcgatgtcagcgtctgatgtatgccgttcttcggccgaatctttcagcacacagcccgcttcattgataaggtaatccgcaaggcggcggacagatgaatattcaaaaagcagtgtcggataaaactgctgctgaaaagtctgctctaatatctttacaagcttcagcaaatgcgccgagtcaagccccatatcataaaagcctttccgcacatcaatatcctgtgccggacgattgatcagcctggcgatttccgactttatgtaagtcaccatgttttgttccggcgtttgctgttcagacacgtcttctgcggccacaggactttcgggctctccacggccgtttttgttctgctgaggcggcttctctttgtctatcagatgggtaatcatattcgcttgtctgaccctttttactgtcagtttctcacattcggccaatacgttcccttccctgtcgtaaatcgtgaagtcggccgaataaaaatcaggttcgctatctgatgcgccgctttcagtgcggctgttttccgcagaataagtgtaaatcgttttcggaaacggctgatatatgcaaaaacgattaatcataaaaggaatatacggtgtgtcattctgcttttgggccgacaatgcaaaggaagagccggcaagggtggacgcatctaaaaaagccggatgcgccttgaatttctcccggaatccttcagccaaatcactcagagtgagctccattaattcttctttatcctgaagctgataaacggccccttcatttttcataaactcgccatgctcaatatggcttcttcttgcaattccgtaaatgtcatgcatgtcccattttcggcttgcgtttttcatgaatgcttcaatattcagctcttttgcccggggcgtgtctttttgcaaataaagctgacattccatattctcatcccgttttccgccaagcggtgtgccgttttttgctttttcgcttgtaatctcaactttccagctgtcacgcgccggcgtaaaggtgacatacaggtgtttatcaaactcttcagatgttacaacaggctgcttaaaaataatctgtcttaattctataggcctttcaccgagatacccggcggcgagccgatacagcatatctattaaagtcacgcccgggaggacgcggatttggtgaacgcgatgatcccggacgatataattcgtatggctgattttctgcaggaacgttttgacttgatcggtggcaactgccaatctatcacacctcgcttatttcaaacattgcttctgtgcccgcctcattttcttccgcttcggacaactgtgctttttcaggccaataccgctgttttcggtatactgtctggccgcctttcggttccatggtcgcttttcgttctttcggaattccttcgttgctgacaatgatatgggcgttattcccgcccaaaccgaacgcgctgaccccggccctgagtatctctttttttccgtcccaccgcttcagctcaagcacaggataaagcggcgaatcatgaaattgaaagcgggggttcggtttatggcaatgcaaagtcggcggcagttcttcattggcaatcgccagcaaaactttgatgattcccgccgcgcccgccgcactcagcaagtggccgatattgcttttgacgctccctacaccgcaaaattgtttttcatcggaataagcagacaagacattggttaatccttttaattcaatcgggtcgccgatcaaagtaccggttccgtgcgtctctacgtatgtcatggtgtccggctcgatttccgctgattgaaccgcctgctcaatcaagtcctgctgcgcccggggattcggcgtagtcacccccattgtgctgccgtcattatttatcgcagagccgtcaataacgccgtatattttatcttcgtcttctatcgctttttcgagcggcttcagcatcagcacaccgcagccctctccgattcctgttccgtccgcatcggcatcgaaagattttgaacggccatttggcgataagattctcgccgcgctcattgtgagaaaaggtttttcatcaagcaaaatgtcaaccccgcccgcaaaggccgcctccgcttctccattttgaatagcctgcacggccaaatgaattgccgtaagcgaactggagcaggccgtatctacgaccaggttgggccctgtaaagttataaatgtgcgccatatgtgcggtaataaaattttgccccgcgccaataatcgcgtctttttgcaaatattgaaatttctgatgaaacgcacctgcccttgcaccggcaaaaacgccgatacggcggccccagagatcctctttttgataaccggcatcggccaaagcttccgcgctcacttcgagccactgcctttgcagcgggtctatcatcggtgccagcgtttctgaaatattaaaatactccgggtcaaattgatcaatatcatgaataaaaccgccccatttactgatgctttttccttcttgatattcacccggctgatagtgttccccggcgttccatctgtccggcggaacttcagtgacggcatccgttccgctgcggagattcttccaaaattcttttatatcccccgcttccggaaaatgacaggccatgccgatgatcgcaacctttccccgtttcccgggcttatctgccgtttttttgctctgtttcggcgttttctgcaaagggaccttctccgcgggaaccgctgcatctgccgaaaaagcttccggacaatgtgcggctaaataatccgcgagctgttctatggtagggtgttccagaaggacagtcggatcaattgaaacggacggcagtttttgatcgatctttgtcagcacttgcgccagaaagatagaatccattccgtattcctgaaaaggcacatcgatatccatatgcgtttcatcgatactcagctcttttgccaaaagcgacttcagccaagattgaatatcagtccggttatggacccgtttttttgtttcaggaggtttggaagctgttctcattcctttatgggcggctggcttggcgttttcaagcgctttgatgtcccaatcatttttcacttgtgccggcagcacgacagttccgggtctttctcttaaaatgtaatcaagcatcttgagaccttccgcgtcagagtgacgcagcaatcccgtttgctgatacatcccgctttttgtatccctgctcatgcccgtctcatcccatgccggccattgtatgctcatgatgccgccctcattgttttctgcaaaatagtccatataagaattagccatcgcataatcgctctgtcccgccgcaagaatcgggacggctgccgagacagatgaaaacaggacgaaaaatgccggcgcatcatcctttacactctcatacagaccgcggaggccgtctgctttcggtgcgagcacccgcgcgatactgtctttggatttgcggagaaaagcagggttttcacggtccgcaattcctgcgcaatgcagaatgcctccgacaggtccgagcgttgtggttacctcttttataagccgtccgacggcctgcttatccgtcagatcaactgctgagacgcacacttttacgccctgtgattccagctttcggataagctgtattttttccgaaacgacagggtctgtttgctcaagatcccactctgttttcggcggcagctcctttctgcctgtcagaagcagtttcttcacaccgtatgcggaaacgaaatgcttggcgcataaagcgccgagtccgcgcgttcctccggttatcatgaggacggcgtcttttggaaacacagtccggtctgtttgcacggcttctggttcaatctgatcagtctgccgaagaacatagctgaagcgcatgccgtccctgtagcaaacagcagattccgttaagtctgattcaatttcttgtttaataaaagcggctgtctgctccagcggctcttcaggatcaatatcggcgtgacaggtgagaatatggctgtattcatgccgcagcatgcgataaagccccgctttttcaataccatgcatagcggccgcattatttttgaaggattcaaggccttttgtaagataaagcattttcatgttttcttttccgcggccgtattcaatcagctgctgcagcgatgccacccagctgatgtcctgccgcttttgtcgggagccgcagccggtgaagtcaataaacccggaatagatggccgcattcgcatcctgtaagaaagagatgagctgattttcctgcacaatgtcagcatcattcagctgttttttcacctcggcggcaaggtcttttgtatcctcggagacgatgagcgctattttgctgaatggctcggatgaagacactgcctcgcaaggctcccatgttttctgcaatactactgttttttgattcgaaagcggcagctgctcccgtttcggcacccaatagcggtctgctctgaacggataggagggcaggctgatgcggcgaggcttactgtccgtatacagctgctcccaatctgtgtcaaatccgtttacccagagccgcagcactttcttgtatttctttttctcaatccaggcgctgacgaggtcagctgcgtcttcatcgtctgagaacatggagatcgtgttattctcgcgttttttacggccgctgatgatatcttcgctgttttttcccgtcagaaacgcgttcagtttttcagtcagttcctctgcggagcctgcaatgattcccagcctcgcttccattgcgtcccgtccggtctgcagtgtgtatgcaacatctgcaagatcgatatggcgggatgatccgttttggataaaatcgcgaaggagacgcgctctttctttcagccgctcttcatttttagccgacaaaacaaaaagagatgacgctttctcacgggtttccggctgttccgtctcacttttgcccatgtattcttcaataacgatatgcgcattgacgcctccgaaaccgaatgagcttacacccgcccggcggggcaggacccggccgttttcatcacgcagcgcttcccactcctttgtttctgtcacaatgtaaaacgggctgtccttcaatttgatatggggattgatgttctcgcaatgcagacttttggcgagcgtccgatgtttcagctgcatcaatactttgataacgcccgcaatgcctgctgcgagctccaaatgtccgatatttgtcttcactgagccaatcccgcaatatccgcccggagccccgtctgtttggaaagcttttttcaatgcattgatttcaatcggatctccgagcgccgtacctgttccgtgcgcttctatataagtgatcgttgacggctgaataccggctttttgataagcgcttttcagcacatccgtctgagcctgcgggttcggcgcggtaagtgacgctgagcgtccgccgtgattttccgctgtaccgcggatgaggccgtagatgtgatccctgtcatgctcagcctctgaaagctttttcaagacaatcatgccggcaccctctcctctgacataaccgtcagcctgatcagaaaatgttttgcagcgcccgtcttcactgagcatgcctgctttttgaaaaccgatatgcccttctggcgtgacgatcgtgttgacgcctcctgcgaccgccatatcacaatctcccgtttcaatggcttttaccgcgcggtgaatggcgactaaagagcttgaacaagcggtttctatcggctcgctcggcccgtggatatcaagaaaataactcattcggttcggcccgacggacggcacgattccggtcatcgtatacccctcgacaggaagacccgccttattgattaaggtttgatatccgcttcccaatgtgccggtgaaaatgccggtttttgttccggcaatccgttttgccgagtaccccgcgtcttcaatggctttccacacatacatcattaataggcgctgctgaggatccatcatttcagcttctttcggagatatcccgaaaaacagcgggtcaaacccggcgattccatctataaaaccgccccatttaattgacgttttatttgcatccgctgccggatcgccgtaatattcgcgccaattccagcgatcccggggaatttctgtgatgcaatgctctccttttgataaacgtgtccagaattcatctatgtctttcgcttgcggaaaaataccgctgattccgataatggctatcggttcggttttttcttctgattttccttttacggatacgggcgtttcccgtttgacatgaacggccgccggagcttcagcttttcttattccggcttttggggcggttttaaaattctctctttctaagccgctgaatgcttctttccattcagatatcaaatggccgctcagtttgcgcaatgtcggaaattcaaagaagatagtcgggctgagctcaagctgataagaccgatttaatagatttgtaaattcagtgaagatgatcgaatcaaatccgtattccgtcagttcgctgtcagcctcaatatctttcatgcttacctttaaaagatctgatacatgacgctttagtttctcttgaacccgatctttcagatctcctgcatctgtctctgccggagcttttgcggcggcgctttgttcttcacgcagatcgaaaacatggctgcgaatccgtttttcatctccttctgccaccatgatctggtgttctccggaggcaaaagcggcgtaaagcgcctggatgcctgaagccgatcgcatggctttcattccggtctgttcatacatcagccgttcggtctctttgtccacgcgcataccgccctcttcccaaagcggccagttgacggacagggtctgcccgctccgcttgttgtcccgcacgagacgatttcggcgggctgcatatacgtccataaatgcgttggctgccgcataaccggcctgccccgggtttcccatacctcccgccaaggaagaaaacagaatgaaaaagtccagccgcgcatctttcgctgcttcatcaagattgataagccctttcaccttcggcgccatgacggtcttccgttcgttttctgtctggttcagaatgtaattgtcggcgatcacgccggcgccgtgaatgatcccgtcgagtgttccgtgctcctcctgtatgccgcggacgagggcgatgaccgccgccctgtctgtcacatcaaccggttgatacagtacgcgggcacccgacgcttccaagcgccgtaagcgggcggagcggtctttatcaagcgcttccgcccttcccgttaatatgaggacggcgtttttgacgcgggaggctatttcttcagcgaaaatcagcccgatgccgcccgctcccccggtgaggaggtaaaccccttcgtctttccacggaacggcgccgctttgaagcgcaggcaggtgacgccagtttctgacgagacgtttgccggcttcataacggatttccgcttgttcagggtgcgtccggttttctttcagcttggcaagaagcgatgatgctggctcgtccggatcggcttggatgacttggccgtacagcttcggatgttcaaggtgagccgttttcaggaaagcggccagccccgccaatacattgtcttcccccctgtcggggacaagaagctggatcagcgtttttcccttctgtttttctttgataagacgcttgacgatcgctgacagctccgccgcgcaggcgtcataacggtcttcaatcggaccttccccgtcagccgcacatacggcgccgtttatgtcctcagcgttcattccgccatacagcgtcacgtatctgaaagactctgcttgtccgccgccttcacccggcggtgattcctgccactttggctgaagcaagagcggttttccctccgtttcctcttccagaaaacgggcggtgagccccgtcaatcggacgcatacctcgccgttttcatcacacagctcaatatgataggcgccgtccgctgaggaaagcaccgcccacatcgtctcccggcacgcagaaaacacctgcatatcccggagggcaaacggcagaaacggccgtccggacgcggaaccgtctgagagcacgagaccgatagaagcctgaagggcggcgtccagcatgctcgggtgcaggaagaacggctccttttcttcgcgggcggacggcggaagagtgagcttcgcgagcacttctccgcttccggcatagacggcgtcaagcgcctgatgagacggtccgtaggtgatgccgaggctgtcgaatgcttcataacactcagcctttgacatgtgccggccgccgcagcgcgcctgaaccgcctccacatcgagtaccggagcacgctccgtctcttcgagcacggcctttccctggaaaaagacaagcggctcttctccttcggcatacgcttcaaaagcgatgtctccgttttcttccggctgaagttttacatgaagcgtcacgccttcagaaagcgccgtcaccggacggagccaaacgatctgtttgagccggacacccgcttttccgcccggcaagccctcagcggcaagtgtaacggcggcccgggccatttctaaagcagccgcgcccggaagcaccggttttccattgacgatgtgatcggcaaaaaacggttcacgccctgaaaaaacagaagtaaagcgctgggcggtaaaggtcgatgtattcgcatggagcagcgggtgaagcttttcacgttcagctgaattccggctttcaagctctccctgaagacgatcggacgcccaatacgtctgcctggcaaacgggtagcccggcagattgccgattcgcggcaaaggtccgccataaagcaagtccccttcaatttcataaccttgacaataaaaatctgccagcacgcataacagttcctgatattttctatggtcagaatatgaagcgctgcacttgccgagcacttctattatgtgctcctgaatatgctgtcggcctgcaaagtgctgcggtacttttcccgaaaacacataaggatgatgttcattaagctttgcctgcttccatacatacactgcgtcatcagcatcttgaaccacgatggcggcgcgatggttaaagtgatgccgtccttttagcaacgtatagctgagctgggctagatcattttctttcagtccgccattttccgcccaagtgatcatatcttcgattttttcctgaagggcctcctttgtttttgctgataaagtcagtaaataagcaggggcatccggatgaggtgaagcgctgcgcttatagctttccataacgacatgggcgtttgttccgctcatcccgaatgcgctgactgcccccattcggtttttacccggcagagaaggccacgctttagccgttttattcacataaaaaggacttttctcccagttgatatagcggttttccccgctgcaatgcagactggcgggaatcatttcacgggagaatgcctgtaaaagactgatcaaactgacaatgcctgacgcggcaaacgtgtggccgatattggttttaattgatgtgagcgcgcaaaatgcttcttcgtttgtataggcagaaaatgcgtcataaagcgcgttaatttccaccggatcaccgagttttgtacccgtgccgtgtgtgacgatatattcgatatcttcagggttgatacggccccggtcataaacggaagtaagcagccgggtctgcgcgacgccgctaggagcggtaattccgtttgttttcccgtcataattgatgccgctcgcccgaatcaccccgtaaatcggatcgccatcttcttccgcctctctcagcggcttaagaacaaccgccgcagccgcttccccgggaaccaggccgtcagcccttttatcaaacgcgaagcatttcccgttttccgacagcattccggctttatctatcgtttcaaaaaagtccggggtattcatgatattcaccccggccgcaacagctgttgtacactctttattctgcaggcttaataccgcctgatggacagaaacgagccccgaagaacatgctgtatttatcgccatcacaggacctgataaattcaagtgataagccagccgcgccgccaaaataccgttatgatgagacgtgacattgcctttgtcccgtgttaaaaggtgataatctccttcttccgcacccacaaacataccgatcgtctgctgcctgatgtgactggcgccgtagccggcatcctcaagggcccgccacgcttcctgaagtagcagccgctgcttcggatccatcgtttcagcttccctcggcgatatttcaaaaaataaagggtcgaattcgtccgcccccggtacagcgccgagtttccattttgaacttgtgaagcctttttttgcgaccggtgcgacaacgtccttttcctgaaacagaatgtcccacagctcgtccgccgtgcgcgcctgaggaaagcggccgctcatgccgataatggcaatggaatcagctgcctgactgccctcggttccggcgttcagcttatttcttcccctctgcttctttcgcttttccgttcctgccttttcaaagacagattgatctgcggattcaggtttcttttcttcatagacatgctctatgacggacttgtgttccgtcagaaaatagcggacgaccttctccagtgtggaatgtccgaaaaacagggccggggtcacttcaattccgtagtgagcggacaaagaagaggcgaattccgccaaactgatagaatcaaagccgaaatcagccagattgtcagcatccgtcagtctgttcttgtctattttcaaaagccccgccgccagttccttcacatcccagcttacgcattcttccagtgtaaagcctttcatttcactccgccttcctgaaaacgggacgttcctatttacagaacccgaaatcggccgttcgccttgatctatctgcaggaagcgtttggccctcgacggaaaaccggccaggacgagatactggctggacggctggactaacaatgtttcaaaagcttcgagtccttcctttgtatataaataacgctgtccgcttgattttaaatacatatcggtgctttccgccgtgccgacatgcatccccccttctttccaaagcggccaattgattgcaagtgacttgccgcttctgagtccgaggctcacaagtttatcccggtggcggataaaagccatttggaagcggttccccattgcgtagtcacaagaaccgaagtctcctaaaatcgctgaagaagaagagaaacaacagaagaagtcaagcggctcccgtgacagaacctgatctaacaccgctgtgccgtccgtttttggcgataagacttgctgaaaggtttgcagatctttctccagaatgctttcagtgccttgaagacctgcagcgtgaatgacaccgtgaatcggcccgcatcctttctctttcgcttcttgcaaacctttctccatctgagcctgatctgcggcatccgcctgcacgtaaaacaccttggcgcctgattcttccaatctctttatcttgtgcagcaccgggccgcctgccgctgatctccccgtcaaaatgagcgtaaccggtcctttttcagcaaaatatccggcaaataacaagcccaaacctccgcatccgccggtaatcaagtacgtttttccgctttttatcacacgcctctcaacaggggcaatatccgtctgcttcatttccatgacgtgacggatttccccactgtacatgacactgcggaacgacccgctgtgaagctcttcacatacattatggatcagcttttcaaacggtcctctttgtccaaaataaaccgcggccgtatccgtctccggcaggatcagtttcagcgaccgttccagcccgatccatgactcggcgtaactgatatcggtttcggtcccgcactgagcggaaagaaggatccgcctcggtttagaacgcaaagaagcagctgcgcggatcacatgatacagaatggaatagtctttcacggccttttcatcttcaagcggccatccatacaaaacggcatccgccttgcctgcagccgtttcaatatgccgaaacgtttcttgatatgcttgtccgtcagtgattttaatttgataatgcgtgtttgaaagcttttgagtttcctcaccctgtgaaataaaaaacacgccggctcccggataaagggattgtaaagaccgataagcatgttttctggcagcttctcccgtaagaaaacagatgaccgttttcagctcttcatgaatggatttcttcagaggctgctgcgtccacctttcttcaaatatcatcatctcggagtgttcctcttgcccgtgatcctgctgagacggctgtctcattctcacccctttgatttctgcgcatacaatgccggtttcgtcacaaaattgaatgtcacagccggtttgattctttttattcatatacatccacatgccggatgaacacggacgcatgacgcgcagttcttcaaccgtttcaggcacgatatggactgacggctccgtttttgccaagacatgaaaagctgcgtccagaaattccggcggtagatgatatcccggattacggccgctttcatctgtaagagcaagcttcgcccaaatcgcattttctcccgtataaagcttttcaacggtgcggaactccttactgatcgttacacctgatgtgcctggtgtttcataatcgaatgacagcgggcgacagtctttttgtaaggaggcaatatcaagcatgcgggatggctgtacgttcccttgaccgatgattccataatgatgcagcttctcttcatcactgtatatttcataatggatgccttcctcgtcttcagacagaagggagagattgacgcccgcaccgtgatgtccgccggtaatcgggtcagtccatgccgccgttcggatccatatctctttttcttcagagctgtctgccgcatgatgataagccgcaagcgccatttctaaataaacggctgccgacagaacccgctctcctctcacatcctggaaaacgtgttcccggcctgtaaaagatgtatgatagctttgctccgccaaggttgacgtattttcatgcaggaaaggatgcacatattcagttgttcctgtttttggttcttcccgcttcatccagtagctttcttttgcaaatggataagacggcagactgatacgatgcggcagcgcgcctttatataaagatgcccaatcgacgggcgccccgtggacccaggcattcaaaagactgccaaattgacgtttttccatccaatcaccgactgtgccttccgtctctgtgacagcactatcactccggcccgtaaacaccccgcttacggaatcggcattattcagaaaagcagtcagcttctgttccaattcagaaacagagtccgctgtcatcgccagccgttcttccatctgaaccctgccgacttgaagggtaaatgccgcgtcaagcagatttgcatctgtaattgttccgtttccggcggcatccgacagcaacagagcccgctcgcgcaagcggtctttatcttttgccgataaaacaaaaagcgccggacggccggagtccgccgaagtcatttcagccggttcatactcttctatcagcagatgggcatttgccccgcccgctccgaaagaagatgtacccgcgattctcggatattcccgtgttactccttcagattctatgaccggccgtctccattccgccgtttcctgctgcacgataaaaggagaagtttcaaaatcaatttccgggttcagctgctttgaatgcagcgacggcaccagatatccgtgtttcatctgaagaagaattttggtgacggcagcaatgcccgccgcactttccaggtgtccgatattggatttaacagaaccgatggaacaaaattgctttgcatccgtatagcggcggaaagccttggttaaccccgcgacttcaatcggatctcccaaggaagtgccggtgccgtgggcttccagatagctgatcgctctcgggtcaattcctgcccgctccatcgcgtctgcgatcacttccccttgtgcattcggattcggaacggtgaacccgttcgttttgccgccggcgttcagagcgcttcctttaatgacaccgtatatatgatcatgatcttcaacagccttcttcaacggctttaacacgatacagccgacgccctctccgtcaacaaacccgtcagccttatcaccgaacgctttgcacgcgtttgacggcgacagcattctcatagaagacagtccgatataatgaaccggatctgtaatcaggtttacgccgccggcaatcgcgcattcagatgcacctgttctgatgctttctgcggcgagatgaatggcggttaaggatgaggagcatgcggtatcgaccgcgatgctcggaccgtgaaaatcaaacacataggatacgcggttcgggataaagtggtagtgggcccctgtcggatagttgccgttcatgacacccgcaaaaacaccaacctttttaccggcgcatagtgaatcaggggtatatccggcatcctcaagggccgcataagcggtttccagaaacagtctctcctgcgggtccatgcgctccgcttctttcggggagattttaaaaaacagcggatcaaatttatcaatgtctgttaaaaagccgccccactttgtatacatccggccttccttaccttttgtctcatcatagtagtcccgccaatcccagcggtctttcggaatttcggtgattccgtgttcaccggtttttaaccgttcccagaactcattaacattttcagctccgggatacttcccggcaagaccgacaattgccacttcaaggtgttttgacggcggttcggaggcgggcggcgctttttcagaaaaagatgccgcttggcgcttcgtcaatccggcgctttttttgcggctttgctttttctgtagagtgtgcggcaccttttcggcttctttatttgtcttgaaaatcccagccatatcttcctgtcttgagctgacgagatattccgctaatccgccgattgtcggatactcgaagaacaatgtgctgctgatatcagggacgtcttcccgcacgcggttggtcagctgtacgattaagatggaatcaattccgtattcttcaaggggcgtatgggcttgaacgtcctcaatcggcatctttaagatgacgctgacgatctgtttcagatactctgtgcttttttcaagcaaagagcctgatgataccgcttcagtatgacggacttcttcagaaaatcgcgcaagcagttcgcgctccttcgtttcagccaagtatgcggcaagctcttctatcgttcggtgttcaaaaaacagcgtgctgctgatatcagggacgagatcccgcagctcgttcgtcagctgaacgatcagaatagagtcaataccgtattcatccagaggagccagcggatttatctcttctgccggcatttttaatacttttgccgcagcccttatcagaaaagcagctgtcttttccgaaagcccttctcccgcttgtttgatggggagctgacgatcagagaatgttcgcggtacgtttgattggcgcttttgcgcggtgtaagcttccctgctctgcctgatgactccgttgcttttcgccgtgataatctgctgggtgtgcagacgttcgttttcagccggaaattgaatggaatgaaagccttcagccattaaaaccgatttccatgtttccggataaagaccggggcaccccggaatccgcagcgcctcgtcttcgtacagccaccagccctctaataagccgaatgtaacatgtgtaaacggcgtatgtccgcccagttcattaacgagcagcaaaccgtcttttttcaatacggcttttgccgtccgtaaggttttccggatatttttggtggcatgcagcacgtttgcggcgatagcgatatcgtaggttctcagatgtaatccctggcccgccgcaggcttctccacattaaacagctgatacgtcaaatacggattgtccgcgccgtattccttttcggcatgcattaaaaaagcttttgacaagtcggtataacagtattcctgaatatggttttgataggggcggagctttttaaacagtgtgctgctcgttccgccggtgcccgctccgatctccagcagacggatgtttgcctcaggattgtttttaattacattttccacataaatacacgcttcatttgccatcacatcgttgtaataatcagcgagaatgttatgcttatagattccttcaacgagctccattgaagaatcgggaaacatcacgtcagtggcttttattttgcctgttaaaatgtcaggcaaagcttgaatgacggtatccgccagcagagcctgcgctttcatatccggatctttcagccattcgtttttcttcttatgccactcttcccaaatcgcggccgtttcaccgcttttaagatcgctgtctaaaagacggatgctttcttccagccagcgctcatataaaggcagacaggaagccgccggcgcttcgccggtcagacccattgaacgcagcgtcacccgcagcacttgcagcaaaagctgattcaattctttcatttgattgcttatttctgttcttaaggataactgtgtacggtctttttgtttgtctcccttacccaaaaccttatcctcctaagaaaattaaatttgctccgtcattttgacaggcaatcagatagtcacaaattcatgagggttcattccctcgatcggaatcggcttggtcagcttcatcagccccatgcgggagatcggctgcgtcagcagagtttccagcgcctgcatcccttccgcccggctgatcagtccgagaccgattgcactcagtctgtcaaactcttcagaaatgtgattgtcagcccgctcccaatacccccagttcatcactttgaccgggcatgacagccgcccggaaagctcatgggcaaatgcgtctttaaatgcgcaccccgccgcataatgactttgattcggattcttaatatatgaaataaccgaagagaaaaagagaataaagtccaaagactctttcgcaaatacttcggcaatgttgacggaaatatccactttcgccgcaaggccggcgtgaaactgtgattcttccatatcttttacgctttcattcgcaaataccatcgctgaatgaacgacgccgctgatggtgccgtatgtgtttttaatctgttcataggcgcgctgaagcgatggaagatcagaagcatctgctgctatatattcgggagccgggcctgatggccggtaccggtctattttttggcgtatccggctgtccagcggccgcctcccgatccagacgactcgggctttatacgccgtcaccatataatctgtccaaacctcgccgatgcctcccgcaccgccgatgatgacatatacgcctccatatcggtaaggaacactttcagacggcccgctttggaccggaagcaattgaggccggtgccattcctgatgtctgcgcacccatgctttacccgtacggtcgcggggcaggctgaatatgtcttctgcagggaaatccccccgtcttcaagatcgaccagacggatgtgccagctcggatgttcttttgcgagagacccgacgaaaccgtgcacactggaatgagcgggacgcacctcatcatattgggtgataggctgtgcttggtgcgtaatcaccgtcatcccgagctgctcttttccatacccgagaccgataagagctttggccgctctgaaaatttgcagcaccccgcttttttgatcatggatgtaagaatcagccggctgaggggcaaaccagatcatatgctgaatctcaccgacacggcggagccgatcggatatcacttcaacggaagcactttggctgctatcaaatcgcacagctttaggaaacaatcgtaaaaccgcgtccgcctgcccgtctgtaccgcctatgatgacagcttttgcttcagaaatggggaagccggtttggttgtctatcggttccgcgtcccatacctgcatcagtttgacggctccggtaaggttacccggcagatcgtattgcttattatcggttacggccggcgcactttcggccatccgggcagaaaatccttttattcttacacacacattgccgcgttcatcacatatatcaatgtccattcttcgcacggcccgtgtttcatgcgtcacaaatacggccgcccacatgtttggactgcacggatgaaaaacggtcagttcatgcaattcaaaaggcattaacggctgctccggataacccgctttatcttcattcataacgccgatggccgcctgaaaagcggaatcaatcagactcggatggagcacaaactgttcggcctcatcacaaacggaagcagggagcaccaatttagccaaggcttctttttccccgcaataaatgtgatcaattccttgatgtgaaggtccgtatacaatttccgcctttgcaaatgccgcatagcagtcttcttttgacagcacttttttgcggcagcgcgctttcagctgttcaatatgcaaaaccgccgcctcagacagcggctcaatcacagcactgccttcacaataaatgtctgaatcgttttcattgctgtacacttgaaatgaaatattgccgttatcctctaaggaaagacctgtcgtcatacgcagcggctcttttttatgaacggcctggcgtatccagctgatataccgcagcgaaatgccggttttagccgtgtattcagcggctaacggcgcggcagccagttcagccgcggctctcgccatttcaagataagccgccccggggagaacacgcttgtttcggacgatatgatcggctaagaagaattcatctccgttcagtaccgtgctgaatttttgttctaacaaatctgatgtattgcggtgaagcagcgggtgaagcctgctttctgtatttacggaagtgacgggatgatcgggctccggtatccaatagcgctccttcgcaaacggatatgtcggcagactcatcctgcgcggtttctcctcccgatacagccgcgtccagtctatctcaaatccttttgaccacagctccgcaagttttttgtaagtgccgctgtccgtccattttcggatcagctcctccgtatcctgatcatcattcaggaaacccctgatttccgttccgctatcagaccggccttgaaagcagccgtcaatctgccgttttcgttctgtaaattcggttaatttcctgatcaggtccgcttgatcgttcactaaaaaaacaagccgttcttccattgccagccgtcccgtttgcagcgtatacgccagtgaccgcagggaaaaaggttcatcagactgcttctctaagccggactgaccgaaaagaccggaaagaatattcttatgtttctcatcgtttgtcagacattctgctaaagtccggacggaagtatgctgtatgagatcagtcatgtctattgccagcccgtattgatccgtcagccgctcagaaaactgtgtcagctgcatgacatccaagccgaattccttccaatcctgttcaccatctaccgagccggcctctacatgcagaacttccgccagagcaccgcgcagcgcattttccagctgattttgcattgtatctgttttgtcataaagcgacccgcttccttcaagcgctttatctttgagaaacatcagcaggcgggcagcgtattccttcagccgctccggatttttcgctgatagaggcacgatatacggtctctcttgattctccgtaatgccggggtttttgggcctgtactcttctaaaatgagatgaacgtttgaacccgtcgccccgaatgaactgatgcctgcgcgtctcggacaggaatgttctctgccgttctctgtatacgccggctttttccatgactcggttttttgctgcacgtaaaatggcgagtcctctaaacggagatacggattaatcgtctctgagtgcaaagaagggacaagcgttttgtgaaacagctgcaaaaccgttttatgaagcccgctgattccggcggctgactccgcatgtccgatattcgatttaacggaaccgatcgcacaaaattgccgatcctccgtaaacgtgcggtaagctttaacaagaccttgtatttcaatcggatctcctaaagaagttccggttccatgcgcttccacataagaaatcgtcctgggatcgatccccgtcttttcaagacattcagctatcatatccccctgcgccactgggctcggcacggtaatcccgctgacggttcccacgtgattgacggcgctgccttttatcaccgcataaatatgatccttatcttcttcggctttgtgaagcggcttcagcagcacggccccgatgccgtcagctgagacatagcctgtgccgccttcgccgaacgtgcggcacagcccgtcactcgaatgcatatccatcaagccgtatgtgatatattttgtcgggtgcaatgataaattgacgcctccggcaagagctgcttcacattcaccgcgtctcagactttccgccgccatatggacggccgtcagagatgacgaacacaccgtgtcaaccgccatgctcggcccgtgaaaattgcagaaatatgaaacccggtttgcgatcggcgcatagttcaagggataaggaaagaccagccctttggccgcagcttcagcgccggcgagagaataatccatatgcatcaccccggcaaacacaccgacgttcattctcttattcggccctttcggctgaacgattgtttccggggtatagcctgcatcctcaatcgtttcccagcatgtttctaaaaacaatcgttcttgcggatctttagcttctgcctcccgcggagaaatccggaaaaatttcgcatcaaaacaatccggatcgtctataaaaccgccccatttggaaatcggcttgccggacggcgatcgcaaatgctcatatttcctcgtatcccagcgggaacgaggcacttccgttacgctgttttctccattttttaaatttgcccagaattcacgaagatttttggcgccggggtaccgtcccgccatcccgacgatcgcaatatctccattctgcgttccggctgacgccgattttttcacgcggttttgggtcgtcctctttttttcccggcgcaaaggttcagcatttggatgcccgctttgagcatggccgaagccggctccgtaatgttcgcgcaaatatcccgccaattccgcgattgtcgtgtattcaaataacagcgtcggcagaagctgcgttccgatttttcgttcaatttcctttaccatgtccaacagccccggagaatccagccccatttcatagtagccgatatccgggtcaatctctttcacaggtttgttcaatcgggcggcaagcaattcttttaaataaaggatgcactgttcagtaaggccggcggaagcctccgcacggcggggctcggaaggcgccggttccgcttgcggagccgggacggcattccgcccgtcaggttctttcttttgccgtttctgattgatcagttccgggtccctcacccgtttattggcgaagtttttcagttcgccgacttttctgccttcctcattgaaaaactccattgtcacgtaaacgagatctttcttacgtgtgacggattctttttttatcttggtgatacatgtcgtctgcagcaattcggcgcaataaaatgattcataaaacagcggcagaaataattgcccctcctccctcgtcaaaggagcgagatatacattggagccgatgctgctcgcatctatcaatgcgggatgaaacatcgcctcttctgcatgttccagctgatccttttgcaccgacagatcaatataaatctctttttcagtctggtagacgcttccgcagcctttcatcattcctgaatgaaccagttcttgatccctgcattccgcgtaaatatcctcaagcggtatttctgccgccgtttgttttacggcatccatccggacgctctcttggaagccggcgggcttgacggaatgcatttgcgccgcggcatatatctttgtctctgctgcttcgtcaccttgtttttgccctttcacctctaccttccactgcccttcgccgttctctgtacagtcaacggaaagcaggattgtttctccctgttcaggagctaaagggtgaaaaatcgataagtgcctgagttcaaggccggcatgaaaaaaaccgttttctctgaaagtctgatagatcaggtcaatataagccagacccggcagcagttcctttccataggctttatgatgtttcagaacgggatgctgattgttaataagaagctgctcttgcatatgaacttcctccatatcgacgttcaattttcagcgcaatcagtaagtcttcatttgtttccaaaacgtattcgggcgggattcatgtgcgttttcatgcaggttttcagctttgtccggacggatgggccggcgttttaattcctgtctcggcaaaggctttctaaccggggtatacgcctcctgctcccaggcttccactatgacatgggcattcgtccctccgtcagcgaaactgctgacggcggcaatccgcggtgaatccgtccattcacgcagaacgtgcgaaaaataaaacggcgaggcggacagatcgtaatgcgtcatcggctctttgcccgaaaggaaaggcacacgcattcggcgcgagagcataagcactgttttaatgaatccggcaatcccttcagcgcataacgggtgtccgatattcggcttcatcgaccccaattcgcaaggcgcgctgttttgcatacggtacaccgcttcaatcgccctcagttccaaaaggtcggttacttcagagcctgaaccgtttgcttcaatgtagctgatatcctccgcttttctgccgcttttggcaagcgccttggccatcacttctttctgcgcctgtatattcggtgtggcaggccccgcggttctgccgtcattgtttacggaaatgcctttaatgaccgcatgaatccggtccccgtcttttacagcctgggccgctgtttttaaatacaccattccgacgccttctcccaatacgatgcctccggtgcggcggtcaaaaatatgaaacgcaggctcttcgcttaacagattgcgaagttcgaacatccggtgggtttgaccggattccagcagactgactcccccgaccaccgctgagtcgatttcaccgcaagaaagcgcctgtatcgccatattcataccgacaagcgctgaagaacaggccgtatccaaaacgagactcggccccttcaaatcaaagaactgagaaagattggccgccaagtaattcgggccggcggcgactatcggattttttgcatgcttcagacggttttcgtcaggcatactgccgccgcgtcctcctaaatagacaccggctgacctgcctttcatttcttgtaaagagtaaccgctgtctctgaacagatgaagcgcctcttctaatataagaaaggactggatatccattgccttgatgtcttcttcgggaataaggaaaaactccgggtcaaaatgcgttacattttttaaaaggcccgcataatccgccttctccgttttccagcgttctttcggcaccctttgaatagccgacgacccttcagacagcagcttccaataagcttcaattgattcagctccaggaaaacggcaggacattccgacaacagcgatgtcttgcgccgctgcagcgccagaaggctgaatgacagcggctgctgtttgtttgggaacgtccgggattacaggctgaaccggttttgaaacggcagctttgatttccggatatgccgtttcaagccatcccgccagcgcagcaaccgtagggtattcatacagcaccgccgggtcaaggtcagctttgatcctctttccgatcgctctggacacttgggcaagcatgatagaatcggctccgtaatcttgaaacggtgtatcagattcaaatcttgacggctccagtcttaattcccggcagcaaatgcccgtcagccactcctctacgctttctgtctcaccctgtacatgctgctttgtttcggtaaggccggttgaaagcatcagacggtcgggctcccatttttccgggtgaatgacggccggcataataacagatccgcaatcgcctgccataacggcatcaaacaggctcagcccatctctgtcagtgatgctctttaaaccgcttttctgataggcccggctttttgattcgcccatacccgtttctttccagctcggccattggatgctcagcaccggaaaaccttttgcggccgcaaaataatccatataggcgttagccatggcataatcgctttgtcccgctcctaattccggcatcacgccggacactgaagaaaacagcgcaaaaaaccggagaggctccttgtgcagcgcttgatacaaaaggtccagtccgtcagttttaggttcaagcacagtcatcatctgttctcttgttttgcggataaaggcgggatgatcgagatctacggctcccgctgcgtgtatcacgcctccaatcggtcccatcttctctttcacccggctgacggcctgctcatattcagggccggaagatacagacagcacttccgttcggacacctttttgttcgagctctctgattcttctcactttatcggaaaacggggaattccgtttgatatgatcatcccactccgctttcggaggcattgtttcttttccggtaagcacgagtttcgtgactccgtaacgttcggcaaaatgccgggcgaataaatatccgagtccccgggtccctccggtgatccagagcgcatggtctttcggaaatgaaaattctttttcagctaagctgtttgtttcctttaaccgcgcgtgatagcgcacaccgtttcggtaacacacttcgatgtctgcagaatcgcgaaaaaactcctctgcgatctggtttgccagctcggaatcttcggcagtccgttctgcatccatatgccgcgagcggatatccttatactcactttggagcatccggtacaatccggccttttttgcacctgagagatttatcgtttcattcgcaaaaggttcaagcccctttgtcacacaaagcagctgtagctttcggccgcggtttctgttgtcgatgagagactgcagacgatgaatccagccgtcatcatgcttgatttccgtcccgcatcccgtcacatcaatcagaccgccaaaccgggccgcgtccccggatatttccggtgatgcagcgtcaatgatttcagactcggggaaataacgggacagctcaacggccaaatttcctgtctggtgatcagcggctattccgatgacgccccgcacttccttagccggaacacggctgctttctgcccagcttttctgtaaaaagcggaattcacgaaatgtttcagaatgtgtttcagcaccgcgaacattgtccggcgctgcatcgtccggccaataacgatcctttataaatggataaccgggaaggctgacgcgatgcggcaggctgccgttataaagctctgaccaatcaatcttcagcccttttacccaaagttccagaagcttcgcgaatttttttcttttcatccatttacggacggcttcctgcatatcttcatccttaaaaacggctagaatatctttatactgtttgctttttcccctgaagcagccgtctgttccgccgtcaataaaacactgcagtttttccgctaactgctctgtcgacgtcacgataaacgccgcacgttcttccatcgcttctcttccggtttgaagggtgtaagccgcatcccggaggctgcggtctgtgacgtcattttttctgatcgcttgaagaagctgctgcgcccgctgcttcaggctggcctcctgtttggcggataataaaatgactgcgggatcttcatctgtgaatggctcagaaatctccctatcaggttcaatatattcttctatcaatatgtgggcatttgccccgcccgcgccaaaagaagagattcccgcgattctcggaatctctttctgcgctccgttttcctcaatgaccggccgtttccagtctgccaattcacgctgcaccgcaaacggcgtccggtcaaatgcaatattcggattcaagcttcggcaatgtaatgaaggggccagctttcgtttttgaaactggagcagcagttttgttacaccggcaatgcctgccgcggcttccaaatgcccgatattggatttaactgagctgatggcgcaaaagcctttatctgacgttttcgtttgaaatgcgcgggtcaaaccgtcaatttcgatcggatctccgagttcagtgcccgtgccgtgggcttcgatacagctgatcatccgcggatgtattcctgatttttcaagcgcgccggaaatcacgtcagcctgggcgctcggactcggcactgtatacccgtttgttctgccgccgtgattgatatgagtgccgcgaatcaccccgtaaatatggtccttatcagccatcgcttttgacagcggctttaacagcacggtcccgacgccttccccgggaacaaatccgtccccgccttcaccgaaacttttgcacgttccgtcttttgaaagcattcgataggcgctgagctccgcataagccgaaggatgcgtatacacattcacaccgccggcaatcgccatgtcacatgcgccgcgaaggatgttttcacacgcttcatgaattgcagtcagcgaagacgagcacatcgtgtcgaccggcatgctcggccctttcagattaagaaaataggaaactctgttggccgctgaactgaacgacgttttcggctgcagggtgccgccgtttttccagtacattccgtacccgtttttcgtaatgccggcaaaaacgccgacccggccgttatacagattctcaagctgttccttcgtataaccggcatcctccagcacctgccagcacatttcaataaagagacgctcctgcgggtccatattcaaagcatcacggggtgaaatttgaaaaaacagcggatcaaagaaagcggcatctttcagaaacccgccccgcttactgtaacttttccctgctttcacggccgcttcgggatcagggttgtagtacctgtccttttcccagcgctcttcgggaatttcggtcacacagtcttttccggccgctaagttatcccagtactcttcaagtgtttcagcttgcggataacgtccgctgactccgataatcgcaatcccttcttttgtctgtttctcattggaaaaagcaggccgttttcttcgcttgataaacgacggaagcaccggaaaatcttcatttgccaaaacctgttctgatatgcctgaacggtgctcatcatcatttgtccattttcggcattcattcggataatccgtgacaaagtgagctgccagggagcccagtgtcttatattcgtaaaaaaccgttttggaaaggtcaccgaaaagcagagacaattcgcggttcaatttcgtcacagtgacggagtcgattccgtaagtttccagcggctcttcagtatctatgttggaaacagcaatttttgcagtcaggccaaaaagcgttttgagctgaagaagcgtttgttcatacaaacgttcactgcggtgttcggcattggtttttccggaagcgcccgtcttgatgacaggctgcagcttcaaccccgacagagaagcccatatttttccttctccgtcacataaatcaatataaaagctccccgccttctcttgtatctcggcccataccttgtcaggacaagattcataaaacaaaagctcgtccaatgaaaccggagcgagcgttttatattctttgccgccaagcagcgcgcatgcctctgtcacactttgcatcacacagggagggaggccgaatcgggcggattctttttggtttgtcaatggaattgatatgtctgccagcatccgtcctgatgaagcgtaaatacgctcaattcctttcatgtgctcactgtattgaacggtatcgttctgagtgatggcttcaatttgctgcttatccatcagggaaccgctgttttccttcaagcggctgatatccagcatgccgggcgcagcatcaactggctgaatcgtcccttggctgtacacatcataatgactggaatcagcagaaaatggattataaatctcaaaccttttggcttcaccctctgcgggtatcagcctgatttcgatatggaacggctcagcctcagtcagaatgggctttgaccacacgatatgcgtcagccggacagccgcagtctcctttactgtcaaaacagccgcagctctcgccatttccaaaagaagttctccaggcataagctttttatgctgtaaagaaacatcagcgagaaaaaattcccggccgctgaaagctgccgagaatccctgtcccgtttcatcggaaatatgctgctgagcaagcggatgaagggaatccgtttggcgaagtcccatccgcatatcataatcgcgcaaaatgccgatcgcatcctgttttgtcatttttttatttttgacgtcagaaaaaacccggtgcagaaactctttcatatggtttcctccattacgctaatccctgtaaaaaccgatcgttctttttacagcggcttctatgcttatttcgtttttctccaattcatcaagcaggcgctcataagtctcaagcggggacgtatcagtcccgtaagtctcccggtgccttatatgctgcgcactgtgcggtatccagcaatgtgttttcgcaaaaggatagacaggcaggctgacttttttcggtctttcgtcctgatacaatttactccaatcaacatgcaagccttgcacccataattttgcaagcattgcatactttcctgcttcaaaccattgatctacggccccgctcatttctgcattgtccgtcatctctgtaaacagctgtttcatcgctttgttccggcctgtaaagaaattctgccccgtctccttgccgctgaggaaatcattcagcgcgttcgtaagctcttcttttgtttcagcaatgacggcaaggcgctcttccatttcatcccggccaagctgaagcgtataagcgatatccgcaagagctccgtcagctgaatgtgacttttccaaatatctgcgcagctgttccgcacgttccttcagctgttccgccgtctttgccgagagaatgaataaggacggctgaagttcaccggccgtccattgtttctcttcaacaggagaaacatattcttcgagcacgacatgagcattgacaccgccaaatccgaacgagctgacacccgctctccgcggcagttcatttccgctatcatcagtcgccgctttccacggctgagtttcgcggacgaaataaaacgggctgccgtcgaggctgatatacggattaacggtttcacaatgcagacttttaacgagcgttttgtgctgcatctgcaaaataatttttaaaagtccggccatgccggcggcaagctctgtgtggccgatattcgttttgacggaaccgaggccgcaatgaggctgatcgggtgccgttactccggctttttgataaagcgctgcaaaagccgctttgagtccgttgatttctatcggatctccgagcgccgttcccgtgccgtgggcttcaatataactcactgtacgggggtcgatgttcgcttgctgatacgcttttatcatgacttctgtctgcgctttcggattcggcgatgtaagggaagccgcccttccgccatgattttccgccgttccgcggataacggcataaatacggtcgccgtcacgttccgcatcagataatgttttcaaaacaatcatgccggcaccttcagctctgacatagccgtccgcttgatcggaaaatgttttgcagcgcccgtcttcactgagcattcctgctttattaaagctgatatgcatgtccggcgacacaatagcattgacgcctcctgcaatcgcgatgccgcagtctccggcctgaattgccctgaccgcacggtgaacagcgaccaatgagcttgaacaggcggtttcaatcggttcgctcggcccatgtatattcagaaaatagctcatgcggttcggaccgattgacggaaccgttccggcagcggaagaaccctcaatctctatatggaactttgaagcttcctgagcgtaaccgctgtttgtcgtgcctgcaaaaatgcctgtatttgtacctgacaggctttttgcagagcagccggcatcttcaatcgctttccatacatgcatcattaaaagtctttgctgaggatccatcatttcggcttcatgcggagaaataccgaaaaataaaggatcaaattgagcggtttcatcaatgaagccgccccactttacattgctcgcatttttatctttctgcggatctccgtaatactgtctccagtcccagcgctccggcggtatttcagaaatacagtccttttctccggctaaattctcccaaaacatttccggattttcagccattggaaatgcacagctgattccgattatcgccacgggctcttcaggttcagctgcggtttttgttttaggaaggcgggacggaatcgagaatggctccgtcttcatttttttacgctcaaccggtttctccgtttctgtttcttcctgtgggccgaatgtatccggatgttccgtcagcaagtattgggcaaaactaaagactgtcgggtattcaaaaaacacggccggcgtcagttcaagcccatacattttatttagttcatttgcaaactgcgtgaatgaaaccgaatcaaatccataatctctcatctctgattcagcatctatttcttcttctttcaccttcagaatgcctgatatcatatgtttgagttccgcttgtactttatttggcagatggacgtgggtcttccttgacacatgaatgctgcgtgacggttccggcgcttcaggcatcaggttttttcgaatccgtttctcgtcgccttctgccaccatgacctggtgtgctccggaggcaaaagcggcgtacagcgcctggatgcctgaagccgatcgcatggctttcattccggtctgttcatacatcagccgttctgtctctttgtccacgcgcataccgccttcttcccaaagcggccagttgacggacagggtctgcccgctccgcttgttgtcccgcacgagacgatttcggcgggctgcatatacgtccataaatgcgttggctgccgcataaccggcctgccccgggtttcccatacctcccgccaaggaagaaaacagaatgaaaaagtccagccgcgcatctttcgctgcttcatcaagattgataagccctttcaccttcggcgccatgacggtcttccgttcgttttctgtctggttcagaatgtaattgtcggcgatcacgccggcgccgtgaatgatcccgtcgagtgttccgtgctcctcctgtatgccgcggacgagggcgatgaccgccgccctgtctgtcacatcaaccggttgatacaatacgcgggcacccgacgcttccaagcgccgtaagcgggcggagcggtctttatcaagcgcttccgcccttcccgttaatatgaggacggcgtttttgacgcgggaggctatttcttcagcgaaaatcagcccgatgccgcccgctcccccggtgaggaggtaaaccccttcgtctttccacggaacggcgccgctttgaagcgcaggcaggtgacgccagtttctgacgagacgtttgccggcttgataacggatttccgcttgttcagggtgcgtccggttttctttcagcttggcaagaagcgatgatgctggctcgtccggatcggcttggatgacttggccgtacagcttcggatgttcaaggtgagccgttttcaggaaagcggccagccccgccaatacattgtcttcccccctgtcggggacaagaagctggatcagcgtttttcccttctgtttttctttgataagacgcttgacgatcgctgacagctccgccgcgcaggcgtcataacggtcttcaatcggaccttccccgtcagccgcacatacggcgccgtttatgtcctcagcgttcattccgccatacagcgtcacgtatctgaaagactctgcttgtccgccgccttcacccggcggtgattcctgccactttggctgaagcaagagcggttttccctccgtttcctcttccagaaaacgggcggtgagccccgtcaatcggacacatacctcgccgttttcatcacacagctcaatatgataggcgccgtccgctgaggaaagcaccgcccacatcgtctcccggcacgcagaaaacacctgcatatcttggagggcaaacggcagaaacggccgtccggacgcggaaccgtctgagtgcacgagaccgatagaagcctggagggcggcgtccagcatgctcggatgcaggatgaacggctccttttcttcgcgggcgtacggcggaagagtgagcttcgcgagcacttctccgcttccggcatagacggcgtcaagcgcctgatgagacggtccgtaggtgatgccgagactgtcgaatgcttcatagcactcagcctttgacatgcgccggccgccgcagcgcgcctgaaccgcctccacatcgagtaccggagcacgctccgtctcttcgagcacggcctttccctggaaaaagacaagcggctcttctccttcggcatacgcttcaaaagcgatgtctccgttttcttccggctgaagctttacatgaagcgtcacgccttcagaaagcgccgtcaccggacggagccaaacgatctgtttgagccggacacccgctttcccgcccggcaagccctcagcggcaagtgtaacggcggcccgggccatttctaaagcagccgcgcccggaagcaccggttttccattgacgatgtgatcggcaaaaaacggttcacgccctgaaaaaacagaagtaaagcgctgggcggtaaaggtcgatgtattcgcgtggagcagcgggtgaagtctggctgctttctcactttccgctgagcctgttttgtcaagtgacacatcagcttttgtgacccaatatcggtctttggcaaaaggataagccgggagactgatgcggcccgggttgcgctgataaagagctgaccaatcgacgtcaagtcctttaacccaaaggtcaagcagctttccgtatttcccttttttcagccaggcatttatggtaagcgccatatcttcatcagaagtgagcgaagccgccaatgaatgatgtttggctgtcctgccccgccagatatgagcatgttcgatatgatcgtttgagaaactcataagcttcattttcagttcttctatcgactcggccgtaaatgcaagccgctcagccatcggttctcttcccgcctgaagcgtgtaagcgattttggccaaatccccgtcagaacgtttttttcttatgacatcatccagaagctggcgggcgcgctctgtcaattgctgctcatttcgcgctgataaaataataacagccggtttttgcggagaaacagacgcgttttcccttggtttcaggctgtcagacggcacatattcctgaatgatgatatgcgcgtttgcccctcctgctccaaaagaggaaataccggcaattctcggatattccttcatttcacccgtgatattcaagacaggtcgtttccattccgtttctttttgctgtacgaaaaacggagtgtgctcaaactcaatattcggattcaattccgccgcatgcaatgaaggggcaatcctcttatgtttcaattggagaagcagtttggtgattcccgcaatcccggcagcgctttctaaatgtccgatatttgatttaattgaaccgatggaacaaaactgccggtcttctgttgtcaggcgaaaagctttcgttaacccgtcgatttcaatcggatcaccgagcgcagtgcccgttccgtgggcttccaagtaactgaccgttctcgggtgaatgtctgtccgtttcaacgtctctgcgatcagatcaaactgcgctttcggattcggcaccatataagcgtttgtcctgcctgctgcgttcagcatgcttcctttgataacgccgtaaatatgatcgccgtctttctccgcttgagcaagcggctttaacacaatcgcccctactccttcaccgtcaacaaaaccgtccgccctgtctccgaaagatttgcatttatcaccgggagacagcattgaaaaagcggacagccgctcatagtgagccggatcaacgataagattgactccgccggcaatcgctgtttcactcattccgctccgcaggctttctgcagcgagatggacagctgttaaagaagaagaacaggctgtatccacagccatactcggcccttgaaaattgaacaaaaacgatactctgtttgcgatagaccagtcgctgggaactgtcgggtaattgctgttcatcacaccgacaaagactccgattttccggctgtcacaaagcgtggccggggtgtaccccgcatcttcaatgcttgaataagcagtctgcagaaacaacctttcctgcggatccatcctttcagcttccgcgggagatatacggaaaaacagcggatcaaatttatcaatgtcatcgaggaaaccgccccattttgaataaatggacccccattttccgcgttcctcgttataaaacgttttccagtcccagcgatctttcggcacttctgtaatagaatgcctgccggcttttacattttcccacagctcatcaacgtgatcggcgcccggataccggcctgacagaccgatgacagcgatatcctggatatagggatctccgtttgtcctgctttcttcctcgttttgaggaattacattcaggttatctgtgtgatcagacagctgctcctcacgcacacccatcgctttcataaatgctctccgctgagaaagaagcaggtaatccgcgatttcttctatcgtctgatattcaaaaaagagggtgctggtcatttggtcaaacacgttacgaaaagcatttgtgagcctgacgaccagaatagaatccaaaccgtatgcggttaaggaaaccgacggatccattctcctgctcggaatctttagcgtttttcctattaattccgtcagatatgtgatgccccgttcccttacgtttggaatcggcgcggcgctttctgcgggagcctgcatccgtccggcgttttcggaatgagcccgtccattcccgaattgccgctcgagcgcttctttacgggaagacagaaagtaatcagcaagctcatcaatggtttgatattcaaaaaacaaagtgctgctgacagaaccgaagacgtcttttaacgcgttggtcagtctgacgaccagtatggaatccaatccgtatgcggttaaaggttcatgggataaaagacgatgcgccggcactttaagcgcttcaccgattaccttcttcatcagttcaacgcttttttctctcaagctgaaatgcaatgtatcatccgaaagaccatctgcgtcatacggacggcgctccggtttttcttctgacgcctgcgggagggcaagcctgaccgttccgtcactttcagccgctataatctgctggcctaagtcgtgtgcggcttcagccggaaacagaggatggacgaacccttcaagtgaaagcgcttccgaccagccggccggctcaacccccggacagcccggaatccgtaaatcatgatcctcatacagccaccagccttcaagaaggccgaacgtcacatggttgaatacggtgcggctgttgatctcatttataaacagctggccgtttttttgcagcattgctttcgcatggcgcagcgtagagcggatattttttgtcgcatgaagcacattggtcgcgatcactgcgtcatacgtgccgatgtccggcgcttctgttgataccggctgctcagcgttgaatattttataagtgacataaggatattccggaccgaatatgtcttctgcatgtaaaagaaatactttagaaatatctgtgaaacaatattcggcaatatgcgcttcatacggtttcaattttctcatgaccgcggcgctcgtcccgcccgttccggctccgatttctaaaatgcggattttcgcctgcgggtctttttccagacgctcccgcaaaactgcaatcaatgtgtcagcaagcttgtcattgaaaaaatcagaaatgatattattgcggtaaatgccttccacaagacggaaggaggagtcagggaacatcacttccgttgccggaagcttaccggttaaaatgtctggaagcacacgcaatgtctcttctgccaatctgacatgcgccctcatgtctttccggcgcagccaagtctcttttttccgctcccattcctcccacacctcccctagatccgttttttccggagcaagcgctaattcagtcaggaagacaaagctctctttcagccatctgctgtattgttccgttatgccggcagccgattgaaataacggcaaagtctcatcaagccttgcgcccatctcataaagggttgatacaagtattttttcaatgagggattccatctctctcatgcagctcatgacatttgatgcttttacccgctcagcttcgtcattctgcgtgatgttaaccgctaattgtccgagtgcggaaggaatcttttccggataaaccgttacttgttctttcagatcatctttcataaaaaccggatctgtcgttttgatcagcgccagctggtcataaggtcccgaaagcagggtttccagcgttttcatcgcttcgggcgcctcaatagaagcgattccgtcccgctccatccgtttccggtattgttctgaagcgacaacgccgacacttccccaaaagccccaattgacaacctttacggcatacggcgctttttgtgagatccgcttagcaaaagcgtctttaaacgtgcacccggcggcataattgctctgtcccggcgctttttgaaacgacatcatcgaagagaaaaacagcaagaaatccagcggttccccttcagctacccgggcaatctgcaagctgacatcagtttttgcagaaagtgaagcgcggaactggtcctcttccatattggcaaaactccggtctgataacacgatggcggaatgaatgattccgcgcacctttccatgttccttcacaatggtgtcatacgcccgcttgagagaatcataatccgcagcatccgcgctgaaatattgcggtgcgggacctaaagccgcaagtcttttcagctttctttcaatctgtgtatcttttttccgtctcccgatccagacaattttcgcctgataggtctgaatcatatattcagtccatacttctcctattccgcctgctccgccgataatcacataaaccccgccgtgccggtataatgaaggctcacctgcatgaggctggcagacggccaattgctggcggtgccactgacctgcacgaaagacccacggatttccctcggggtccgccggtaaagagaagatatcgggaagatgccggtctcccctttgagattccaaatcaagaagccggatgctccaattgctgtattcttttgcgagcgcccccgctaatccgtgtatgcttgcatgactcggattgacctcatcatgttcatgaatcggctgtgcttgaaacgtgcagattgtcaatgatagttgttccgtgtcaaaattcagaagcagaagcgattttaccagccggaaaagctgcatgaccccgtgctcctgtccgtcggccgtatccgcatcataaacggatggaatcggatgatccggcgccgcccatatcatgtgttgaaaagagccttgcgctttcagtgtttcagctatttgttccgcgctgtccaaagaagtgatgtccggaaaacggacatcggaatacatctctttcaaagcctgctgaaaatccggcccgcccccgatgacgattattttttcttcacgcatgaaagacatgccggtttccggaatggtgacggtgttccaaaccggtgtcataagcaattccgtttcacggcttttcttcggcatgacgccggctttttggttaaacccggcgctttcctgcacctcttttatgataaaatctttcactgccgccagcagcacaccgcgctcatcacaaatatgcagatcaaattggtgaacggaggccgcttttacctccgcatgcacaaatacggttttcgctaacggtttaagcagctgtatttctccgaaggaaaacggtacgataagcgcaggctctttttgaaattgcagcacatgcgccattgcagtttgaacagcgccatccagtaaggacggatgcaggatgtactgtttaaaatccgcttccaagtgtgacgggagcgttaatttggccagtgctttcctttctgtataagagaattcgcggatgacctgaaaactgtccttttgcacgattcccgcctcagagaacgagtgatagatgtctttcggctccgttctctgcgtaaatggcgccggaagctgaaagaccggggcctcaaacgacgctccattttctttacaaatcacttctccttgcgaaaagagagtgccgtccgctcctttttccttaatgacatagcttatacgctctttttccgcttcaaactctatcatgacggatcttgggtctgtccctgtcacaatcggctccatataccacacattttgaagagagacgaccgggcgttctccccacaatgccgcgccgtatgccgccatttcaagatgacagactccggggagcacatatttttcgttcactaaatgatctttaaagaaatattcatccttggaaaatatcttttgaaacgtccctttccgggcggatgaaacattctcatcaagcagcggatgcagcgcttcacgccttttgacagattggggctttttcgtataccgctttttttggtcggtcagccaggacgtttcctttaaaaacggatacgtaggaagcggaactttctgatacggcgtctccggctttttgaaaccttgaaggcctttgacccacagcgcggcaaatttttcaggatctgaaacggattggcctgaaacgtccggccgtccgggtgacgcttttccgaagtaaatatgcctgccgccgctgtgcccgctcacaaagccgtccaatcgctgtttcagctcgggaagggatgacgcaatgacagcaagccggaaggagaaaggctctctgcctgacaatagggtggcagcgatattttccaggctgtatccgccggcagaaggcgagttttccaatcgggcaagaaaggagctcaattttccggcatattctttcagctgctgttcggaatgtgcgcttagtacgacggcatgcggtttttgctcagtattcccgtccgcttgccgttttggctgataagcacctacgatcagatgggcattagagcctcctgcgccgaatgaactgattgcggcgattctcggtttatctccttcagccggccacggccgattgtttcggacgacataaaatggcgaatcagaaaaagaaatcttgcggttcagttcctcggcgtgcagactggcgggaagcgtttcatgtttcatgcttaaaagcaccttgattaaaccggcgatccctgcagccgcttccaaatgtccgatattggatttcaccgagccgattccgcagtcatttttctcatcggtctgtttctcaaatgccatagacagaccgcgtatctcaatcggatcgccgagtgccgtgccggtaccgtgagcttcaatgtagctgatatccgccggacttaccgcggctctgtttatagcggataaaatcaggtcccggtgcgcttccggattcggcaccgtatacccggtcgttttgccgccgtgattagtggcggaccccttaatgacaccgtagatgtggtcgttgtccgcaatcgcttttttcaatggttttaacaaaacggctcccgcgccttcaccgggcacgtaaccgtctccgccttcaccgaagctgcggcattttccttcagaagacagaaaatgcgattggcttaaaaacatgtatttttgcggatgtaagctgaggttgacgcctccggcaagcgccatttcacagtcgcccgacataatggcctgacaagcctgatggacggcgacaagcgatgaagaacacgccgtatcaacagcgatgctcggcccatggagatcaagaaaataagaaacccggttcggaatgccccaatataaggagccggggcctttatactgatctttgaggaaaccttcttcgtgtgcaattaatgaatattcattccaggtcactccggcgaatacaccgatttgatccgtcggcctcgccgccgggttcccgtaaccggcatcctccatcgcttcccagcagcacgtgacatacaatttttgctgagggtccattaaatcagcttcccacggggaaacagaaaaaaacagcgggtcaaatcgatccggacgatcaataaaacctccccatttactgtatgacgcgtattttgccgttttctcttccgagtaataagagctgtcccatctgtcctcagggatttcggagacacaatctttattttccattaaattgtcccaaaaatcatgctggttttccgctttcggaaacatcccgctcattccgataaccgcaatatcagaactcctgtccgttcccggttcaggcaccttttcagccgcctgtacaggaagcacttcttcttcctgccggcttcccgtatcaggctccgtttctttgaattcaagaacgctttcgggatttcgtttctgcgcacttaaaaactcactcaatttctcaatgttcggatattcaaacagcagcgtttcagaaaggccggtaaattctttatgcaatatggtcatgatttcttcactgatgagagacgtcacgccaagagtaaaaaaagcggttttatcttctgcttcggtcacctcggcacccagcttttccgctattaccgttcttaaaaattcgttaatacatttcatgaggataccatcccttgtacaaaagaatttttctgtgctttaacaagttaatccgccgtctattgccattgtctgtccggtcataaaggacgattcaggagaaagcagaaaacgaacgagtccggtcatatcgtctgtttcgcctaaacgccccatcggcgtccttctgataatctgcgatttttgtttttccggcatatttttcgtcatatcggtgtccacaaaaccgggcgcaagtgaattgacacggattcctttggacccgagctccctggccaggcttcgcgtcaagccgtcaagagccgctttggatgcgctgtagactgaagtgcctttaaatcctcttgaaccgataatggagcttatgttaacgattgatccggaattttgtttcagcatgacccgggaaacgtttcgggtcagcttgatgactgaaccgatattcagattgaggatgcggtcaatgtcttcatcattggtcaggggcagcagctgatcaaggttcaaaccggcgttattgaccaagccgtctattctggaaaacttgcggtacacttgaagaacaaactgtttcatggcggcatcatccgccgcatccgccgcttcccaataaaagcggtcacggtacttttcactctctctcaatgtgttaataaaatcagattcactgcggctgaaagcggctactttgtaattctcatccaaaagcgcctgtacaatcgcttttccgagcccccggctacctccgctgacgaccgctacttttccgttattcatatttgcctcctgttttatacgtttcttatttttttaaatcggtcattagacagtttccgatctgtaacagagatgatctgcggtatctgatatggctgcagcttctgtctgcaatgagctacggcccgctttctgaaagatttgatatcttcctctttttcaagtacggcctctgccgcgacaatctcgcctgtaatcggattttttcggcccgttatgagaacatcccggacattaggtatctccagaaagacgctttccacctctgccggaaacactttctctccgcccacattaatgatttcactctttcttccgagaattcttatatattcgccgtctgtttccacctggtcaccggtgtcgtaccagccgtcttcatcgaaaggtgagggtgcgtttaaatagccgagcatcgccgactcagaacggacccaaagcgtgcctccggtaattttggtctctgttccggcaccgcctactttcatccaagtggattggctgtcttttgatttcgttgagaatatacccagttcagttaatccgtatgtttgtttcagccgtacatccggaaacagccggtgaatgccgcgcagcgttgattggggcatcggttctgtgccgtaagtgatcagctggagtgaagacaggttatagccggcatccgccttggacatcagcagcatgtttaaaaaagtaggggtggcggggagcacttggacagcatatttgtcgaccgcctgataaacggactccggcgttctgctgtctgatgtgacgatcgttcccccgttaaacagaatcgcaaacagcgtattaatgccgcctatatgatccaatttcagaaaaatgagcgtacgcagcggttttctcttcgccgttttgtatttttcaagcagccggccggcgcttaacacggatgctttgcttttgccggaggttcccgatgtgaaaataataatgcctgactcccctttctcgcgcaggtcatcaagcagagggtgagaggcgctttcagaaccttcacgaagcgtccagctgtcattttcatttatttcaatgatttgattcactttcgcgtcttcaaacatatcgagatgcttttcccttgattcattgctgagagggacaacgatatttcggtttaacaaaagcgccatcagcaaaaaaatggcgttcggggaataatccccgataagcgccacacattctccttcacgtattccgttttgttcaagttctttctgaaaaaagctgattcgtgtcagcaaatcatcatacgtaaaagtctgccctttaaaaatgagaaactcactgtcctgcgtttccctaagcttatcagtcacccagctgatatctcccctgctttctgttttcatgattgagcactgtccatgtatttttgataaatatcacaaatgctgccgacggttgtaatgctggaaatcgtttctccttgggaaaaaggatccactccggtttccatctccatctgtgcgactaattgagcgatatccagtgatgagaagcccagatcctctatgactctcacatcatctcccgcttcgacggcccgatatgactgctgttcttgaatatcctgaataatttgagcgatgatctgcttcatttccttggtttgttccatttgctttcagctccattcttcattttataaacttctgatgacccgtttataatccggaatatgatcttgtgaagaggtcggcaccgccagcagcttatccaccttggaaatggccagcaatgtatgattccttttcatatagacttcaatctgatagctgattttcgccactgagatcataccgagggactcaccgtgaaagtcgggatcgcattcttcaatgtgtcccgtcatataaatatcaagctcttcatctgcaaaacaatttccgtaataatacgtctctctttcaagcaaaaataaatgccgcgcgattgaaaccggaaaacccggcttcgaccggcgcgtcatccattcaaattccgccgcatccattatcttgctgaatttcgcaaacaccatggcatgccccggcgcagcatcctgatcaacaggaacccgatatgaaacggggtccgctgttttgaggtttcccggcttcataccgaaagcgtccgttctgactttctttgaccgcatcagcgcgtaaggcggcttggctagcttagaaagttccgcaatacattcagccttcggcgctgagactttgcgcgtcgaaccttctgtttgtgtgacgtcaacgacaattaaactattggctttcatagaaggaaaccgtccccggtcccactcgcttttatcagagctgaccgctcctttcggcccgaacaaataatcagattctaatatggtttctccaaaccgggagatatcgactccgacggaaacctcgtcccataatcggtactgatcaagaggcttatctgaaggaactttgagatgtgtcataaaataagccggatacaaaatcagcccttggtgatcggccatctgatcaggccggaatcccgttccgtccgttaaatggtgactgtgtgcattgccgaataacagcagcagcgcgtactcattcaaattccctaatccgacatggctcatcgttaattcatgattttcaatcagcatggtagtcctccgcagaaaaaatgtaatgtctggtcatactcagcctgtaatcgataccagcctttgcgcaagaaggccggctgtttcttccatgagctgtttgccgatcaagtcgacatgcctgtttctccaattttcaagaggggttcctttcacccattgattaaacgcgccgagcgcagggccgcaatgaatttggtaatctattttactttcgctttttccttccagagcgagcctcgtcgtatgggaaaaataccatttaaataccatcgccattttgtgtttcggattctgttcggctttggcgatctgttcaggagatttatcacgtttcaactgctcatacacttcctcaaaactgcgctggaaatacttatcttcaattaatgttttcgttttttcatctatttcatctaaagaattgtattgtctgtacaagtcaaagagtttattggctcttgccgggaaaaacaggccttttttcagcacctgcacccttgctcccgcttcaaacatatctcccgcgggagcgtatgacgtatcctgcacgttcgcttcctgaagcagatctttcactgaatcacttgtcccggcttcgaccgtgcattgattaatagaaccggttccgataaattcggcgccgagcagaaacgcggcagcagccgcttccggagtgccgatgccgcccgctgcgccgattcttacttttttcgcataaccgtgcttctccatcatgcggtctctgagtctgatcatggcaggcattaatgtatacggaatcccttggtcggtatgccctcctgaatccgcttcaacgcaaatgtcatcagccatcggaatttcttttgcaagcgccgcttccccggctgtcagccgattgtcagacacaagtctttccagcacatgagccggagccggattcagaaaggcctcagcgacttcaggccgggatactttcgcgatgattctgttttggactgacaccgatccgtcatgattcctgcttaatccctttgccctgtatatcacgagagccggggttatgcccataaatgccgatgcttcaataaggtgaatgccgttttttaaatataaatctatcattctgacttccttgtcaggtgacatcatatgatgaagaagattcattccgaatgtttccccttgccgcagtgcagaccggatggttccgatggcctgtccgatccgttcgatactcaatccgcccgttccgaaaaagcccagcattcccgcttttgccgctttaatgaccatctgttccgaagcaattcccctgtacatggagcccgtcatgtaagcatattggatgttataatcttttttaaaatcttcgttccctaatctcattcccgccgttttttgggaatcagctgccgatgctttaacatcagcagtatcagactcttctttcggcataggtaatgggacggcatcttttttaatctgcctcgtcagttttgtcagcacttccccgggcccgacttctgcaatttcattattttcaagtcctatcagacggcgtatcgtgtccgtccactttacctgattggtcatttgcaaagtcagatttgttttgatttcatcattcttataaggtgcggcatgaagatttgagatcaccggaaaacgaagaggcaaaaacgccgtttcttctaaataatccgcgaactctttttcagcatctttcatatagcgggaatggaaggcgccgctcacatttaaaggaagatacattctcacgccggctttttcaaaggcggggcccgctttttgaatgtcttgtttcgttccggcgatcacaatttgcgaaggtgaattgtggttagcgatatcaatgccggtcagatgataatcggatagaacctcttttacttgttcagccgtaaaccccaaaaccgccgccatgcctccgggagctgccttgctcatgagctcccctctttttttcacaagctgcaaaccggtcttaaaatcaaagcagccggccgcaaataacgcattatattctcctaaactgtgccctgcggcgtaatcgggctctctgccggactctttaatcttctttaaataactgagtgcacttaccgtatataacgccggctgggtaaattgcgttttccccagctgatgattcggatcctccaggcacaattcttctatagagtagcctaatatgtcatcagcctgacgtgtcagatcttgaaattcatcaaacagcccggctcccattcctttaaattgagaaccctgccccgggaacacaaacgtaagcatcttatcctcatcctttccccatcgccaattttgtacatcacatgtggttctccatacaaaaacgtctcttatttcatatattgactggtgtaaacaccgccataaaaataaaaacacaaacgcgtttgcgattcagcacaggtttaaaaatcgcaaacgcattgtgttttccttttctaacataatttatattaaaacatcttgcttgtttactgaatgtttcgcatgacaagctgcagtgccaatatgcccgaaaacagccatgacggcacacttctcccttatcatgtatatgtagatatatacactgcaatcatttttataatccctatttcctcttcaacgtgccgaaacagcgattgaaatttaataggtgctttactttaatttaataaatttaacaaatagttgctatttaaagagaataatatcaatttatagataataatgtcaaggctttatttcgttattttctgacatttattccacagttttatattcggtggacagtcggcataattgtttcgggataaatgtcagataattccctgaacccttttcatgtcaaagaaaattcatcgcctctctgtcaattgggtctatacttatttttcattttcatatattatgtaaaaaaaagacgaattagaaaaatttttaatcactttaaatactatccattaaatactttctttgtataataatttcttattattctaaggaggatccagtcatgaaatggtacgcactttttgtagagtcgggaaaagaagaagcagttcaaaaatttctgcgtctgcagtttgatgagcaggctctctactcaatcatacccaagaaaaaagtcacagaacgaaaagccggaattaaatacgaggcactcaaaaagatgtttccgggatatgttctgtttaaaacaaagatgacagagcggacatttcataaaatcaaagaactccccatttcatgcagaatcgtgaataacggagcatattattccaaagagcgcaaaacctatttcacgacaattaaggatgaagaaatcctccctattatcaggctgatcggagaaggagacactgtagattattcaaaagtctatattgaaaattcaaaagtaaccgttgcctcagggcctcttaaaggaatggaaggcattattaaaaaaatcgataaaagaaaaagacgcgccaaaatctgcctgtcttttatggggctggacaaaatggtcaacgtcggaattgaagtgctctccaaaccctagcatttcaaaaaaagcatcaacagcatgtgccgttgatgccctttttatataaacagacgaaagcccgacatcaaaataaccccgctcaccaccgtcacggtcaaatttttgttttcaaggcatagttgacctgaagccgggctgcgcctatgagacaaaatcacatttaggggaatcattttaatcaagagcggtgaattgacggttgagcttcatgacgaaaagcatgtgctgacttcgggcgatgccgcacagttattttcattcctcggaaccgatgacatatttattgctggtctattatcctgaaccggcttaaacgcatatcaggcttcttcaggcagaagcctgatggaccgcaacccattcttgtatgcattgaatcagtttctggacagaaggtgtctgcgtctcctttgcacgagctgtcaaaatgccgagctgcctggagacataccggtcgaaccgtttgatgagcacatcaccatcattcaccaaaagctgcggcaagatgctgatccccagattattccgcaccattgcaataatcgcttcatcccctctgatttgataagcaacccgcggagtgatcttttcttcctttaacactttcagcacatcaaaatgtgtctccggataaggcacgatacatttgacggactccatgacatgtaacggaaccgtttcatattgcgccaattcatgctgcgggctcatcaccgctacaatcgggtcctcggccaacgggtaaaaatgccacttctcgctgtgggatgtcccaatcgccgcatcaatccggtcatctttcagccattgttccagctcagtagaatttccatcaaataaatgcaccttaatagaaggatacagctcattaaattccctcaaaattttcggcagccattttaccgccacgctcgtaacagtgccgagccggacttcccctctttctaacccattaatattatcaacggtttgagacagtttttcatagtttttttgaatttccttcataatatgtaacactttcaagccatttgcggtgggcctcactccatgccgctgtctgatcaaaagcggaaaaccgtactcttcctctaatttactgatcatttggctgatgttcggctgtgtgtaattcaatatggcagcggcttgggtcaggctgccgctttctaccgttttaataaaggctaaatgcttctttaaatccaatcggcttcatctcccagatatcattctttattatccaatgcattagttatatttagtttacttatacatcaatcaaaaataaaatggcaatgtctccatcattatacttgataacaaacagaaggtgagcgtttcagcatgagttttctcattcaattttttatcggcggcaccgttatggtggccgccgcgtatttaagcaagtcgaaatacttatttttatcaggcgttatcacattgctgccgatcatgtcgttactgaatattcacttgcagctgaaaaatatgagccccgacgatttcagagccgctcaaaaaaacggaatattcggtgccttcggcgcagtgatcttcatcagcagtattttcatcctgacaaactggatcaaaggaggccacgcagtcatcggtgcgtttctcatctatatttgctatatgatcggctgtaaatgcctgttatgaagatacggccacgctgtgtataaaaaaatgcccgtccagaacaataagaacgatctgttcagttgtgagcagtttatatgactgaatgatcatgagttgttataatcaatgtcgaaaaacattccgggaggcgaaataaatggcgagaaaattattcacaccatggaccgttaaagatgtaacgatcaaaaaccgtattgttatggcaccgatgtgtatgtattcctcacatgagaaggacggaaaactgcagccttttcatatggcgcactacatatcgcgtgcaatcggacaggtcggcctgattatcgtggaagcgacagccgttaatcctcaggggcgcatttccgatcaggatttgggcatctggagcgatgatcatatcgaaggttttgccaaactgacggaacaagtgaaagcgcaaggatctaaaatcggcattcagcttgcgcacgccggacgtaaagctgagcttgagggagacatttacgctccgtcagccattccgttcgatgagcagtccaaaacaccggctgaaatgacgacagaacaaattaaagaaaccattcaggaattcaaacaggcagcggcgcgcgcgaaagaagccggctttgacatcattgaacttcatgccgcacacggctacttaatgcacgaatttttgtcccctctgtccaatcaccgtacagacgaatacggaggctcacatgaaaatcgctaccgcttcttaggcgagaccattgaagccgtcaaggaagtctgggacggcccgttatttgtccgtatttctgcatcggattatacagacaaagggctggacattgcggatcatatcggttttgcgaagtggatgaaagaacagggagtcgacctcattgattgcagctcaggcgcactcgttcaagctgatattaacgtcttccccggctaccaagtgagcttcgcggagaaaatccgtgaacaggccgaaattgcaacaggcgccgtcggtttgataacgacgggaacaatggccgaagaaattctgcacaacaaccgcgctgaccttatttttgtcgcgagagaacttctccgcgatccgcactttgcaaggagtgcagcgaagcagctgaatactgaaataccgtcaccggtccaatacgacagagcatggtgatgaagtgacagccggagtttttcgatcccggctgtctctttttttatttttcgagaaacgattgccgaagcttctccgtcttccctatagaaccaattagaggagatgactccaatgaaagcagcatggatggaaaggacatatctgattgacgggtgtccgttttatacgaaacaccgtaaaggcgccggcgaagtgacgatcgtctttgaagccggctacggcacttcttctgaaacatggacatcattactcgctgacatagatgaagaatttggggttttcacatatgacagagccggaatcggcaaaagcggacgaagccgaaacaagagaacggcggaccatatggtacaggaattaagcgctcttcttctgaaggccggcgtcaagcctccttaccttgtcgtctcgcattcatacggcacgattatcagcagactttgggcgagccggaaccgccgggatattctcgggatggtgctgcttgatccggtttctgaggatcaggagacgaaagtgcttccgcttcttcctgaagaaatgaaggccgcctatttgaaacagttcaaattggaaggatcacacgcagaatttttaacgagccttaggcagatccagcatcagcagattcatttcggcgatatgccgctgttgattttatcatcgggagagcgggatgagcgcttaaagcacgctcatgaacaatgggtgaaactgcacagaagcatgcttgatgtctcttatcaaagcggatggattcaggccaaaaacagttctcatgccattcatcacgatgaaccgcacatcgtccaccttgccatttatgatgtttggtgcgcggtgcgccagcaaatgaatgctcctgcctatcaggcggtaaactgatgaaaacaaaagccattgtgcaacggcacaatggcttttgttatcgtgatctatttggtctcacgatgcaaagtatactttttcaaccggggtgaatactttttcatttctaaccggtccggattcgtccgtttgttcttcgtcgtgatataatttctgtcccctgtctctgtacaggccaatgtaacattcacacgcatcattttcaccccttttttaaatcgtaattattacgttttattatatatcatcagaaaaaaatgtcaagcgtctattttttaagaccgctccacagtgacctccatgaagtcaaatgcgatcttactgttttcaaataccgctttcgcctcatgttcgagacgctctatcggcgattcaccctgataccttgcgctgatatgagttaagatcagctgtttggcgcctgctttttttgccgtttgcgcagcctgttctgtcgtcgcgtgataataattatgtgcgagctttgcatcttccttggcaaacgtcgcttcatgaacaagcacatccgcattgcgcgcaagctccgttacccgctctgatgccctcgtatccccggaaaaagcgacgattctcccttttttcggggattccagaaaatcccgcccattaatgattctgccatcgtcaagtgtgaccgtttcgccttttttgagtttctgatagacgggtccgggcgggatattcatttctttcaatctgccggcctgcaatgcgccgggaatatccttttcctgaacccggtagccgaacgcttccacaccgtgaatgacggatgctgcggtaacaatgaagtgctcatcttcaaaaaccgtcccctcttcgatttcatgtacggtaagaggatacgtcagatgagtcgccgtcacgttcaggcttgtttcgataaaggctttaatgccttttggcccgtaaatcgtcagctcttcttcaccgccctgaaatgaacggctccccaacagacccggaagaccgtaaacatggtcgccgtgaaggtgggtgatgaaaatcttttctattttcctcggtttgattgttgtatgtaatatctgatgctgagtggcttctccgcaatcaaacagccatacggaacgcctttcttcaagaagcttcagcgcgacggacgttacgtttctcgtctttgccggcatgccggcccccgtccctaaaaataataattccacaatgcttcctcctagatctttgtactactaaggatacaggatcagactgaaaatgtgaattcacccgggccttctccggcctgattaatttttttccgcaaaccgcaaaaaacaggctgaaatgtttgctttcaatgaattttagatttaaaatgaaggaaatatgcggggttttaaaccatgcttcagataaagtgaggtactctaagtgaaaacaaacgacaaaccaaaagcagtaattgtaatatttggtgccacaggggatttggcaaaacgaaaactttacccatccattcaccgtttatataaaaatggtcaaattggtgaagagtttgcagttgtaggtgttggaagaagaccttggtcaaacgaggacctccgggaaacggttaaaacgtctgtttcttctgccgggcaaaaagacatagacgatttcacatctcatttttattaccatccgtttgatgtaacgaatccgggttcctatcaggagctgaatgtcctgcttgatcagcttgaacatacatatgaaatcccgaacaacagaatgttttacttggcgatggctcctgagtttttcggcacgatcgcaaaatcacttaaaaacgaaggtgtcacagcgacaaatggctggtcccgtctcgtcattgaaaaaccgttcggccatgacctgccgagtgcgaaagagcttaacaaagaaatacgcgaagctttcacggaagatcaaatttaccggatcgaccattatttaggcaaacaaatggttcaaaatatcgaagtcatccggtttgcgaatgcgctgtttgagccgctgtggaataaccgctacatctcaaacatccagattacgtcaagcgaggatctcggcgttgaagaccgcgcgagatattatgaaaaatcaggcgcactccgtgatatggtccaaaaccatattttgcaaatggtcgctctcttggcgatggaaccgccgattaaactgaacacggaagaaatccgcagcgaaaaagtgaaggtgctgagagctctccgccctgtcgctccaaacgaagtgagtgactacttcgtccgcggacaataccaagcgggaacgattgacggaaactctgtaccaagctatacagatgagcataatgtagcaccggattccaatacggaaacattcgtgtccggaaagctgttaatcgataacttccgctgggccggcgttccgttttatatccgaacagggaaacggatgaaagaaaaatcaacgaaaatcgtcgttcaatttaaagacattccgatgaacctttattacggcaatgaaacgaatgtaaatccgaacctgcttgtcatccatattcagccggatgaaggcatcacactatatctgaacgctaaaaaattaggcggagccgctcatgctcagccgattaagctggactactgcagcaactgcagtgatgaaatgaacacaccggaagcctatgaaaaattaatccatgactgtctgctcggtgatgcgacaaactttgcccattgggacgaagtggcgctttcctggaatttcgtcgatgcgatttccgaaacgtgggcagccgacaaaaccctttctccgaattatgaagcagggtcaatgggaccgaaagcttcggacgatcttcttgaaaaagacggtctccactggtggaatatataagaaaaaatttaaaaaccgcggcgccgttcatgacggcccgcggtttttaatatcagaaaagcccccgcaatcaatgcgggggcttcttcattacttcatccattcagtatggaaaatgccttctttatctgtgcgttcatacgtatgcgcgccgaagtaatcacgctgcgcttgaatcaagtttgcaggaagcactgccgtacggtagctgtcgtaatacgcaagtgcgcttgagaacgaaggtaccggcacgccttgggctacggcaagtgaaatcacttggcgaagagcgccttggtagctttctgcaatgtttttgaagtagctgtctaacagcaggttgtcaagctccggttcacggtcatatgcgtctttgatcttttgcaggaacgccgcgcggatgatacagccgccgcggaagatcatcgcgatttcaccgtatttcagatcccagttatattcttcagacgcggctttcatttgagcgaagccttgtgcgtaagaacagattttactcatgaagagcgcttttctgaccgcttcaatcagctcttctttattttcagtgaccggcttaacgtctggtccggacagaaggccgcttgctttcacacgctcttctttcattgcggaaatgaaacgcgcaaaaacagattcagtgataatcggaagcggcacgcctaagtcaagagcgctttggcttgtccatttacccgttcctttttggcctgctttatcaaggatgacgtcaactagcggtttgcccgtttcttcatcttttttagtgaaaatatcagccgtgatttcgatcagatagctgtcaagctctcctttgttccactcagcgaatacttcgtgaagctcttcggcagacaatccgagcacctgtttcaaaatgaaatatgactcagagatcagctgcatatcaccgtattcgataccgttgtgcaccattttcacatagtgtcccgctccgtccgggccgatgtatgtcgtacaagcttccccgtccactttagcagaaatggcttctaaaatcggttttacgagttcgtgcgcttccttttggccgcccggcataatagaaggccctttcagcgctccctcttcaccgcctgatacacccgttccgataaagtgaatgccgctttcggcaagctctttgttccggcgctgtgtatctttatagtatgtatttccgccgtcaatcaaaatatcgtctttttccagatgaggaagaagagattgaatcgtcgcatccgttgcagttcccgctttaaccattaataaaattttacggggtgtttcaagagactggacaaactcctcaatgctgtatgtaccgacaacatttttaccttttgcctcttctaaaaactcttccgttttgctgcttgatctgttgtatacagacacagaaaatccccggctttcgatgttaagagccagatttttacccattaccgcaagaccgataactccgatttgttgttttgacatattctaacgtcccttcttcaaacgtttaaccattttaaaatttaaattaaaataaaatgatatttatactaaagaaattatcatacataaccccttttttcaagttattcaccttttcttttcatcctgaaaaaagtctctgttaaagctcgtgccccttgttttgctttcttctttttttataacggcgccttttctgatcaggttttggccgtacttttcattcagctcgttcatcatctgaaaaatcggctcatcctttgcgtcctccttgaatgaaaacagatcaagctgtttatacgcctgctgtttttcaaccagttccgtcccggtgatgccgagaagccttaccgggttttggttccagtgcttgtcaaacagttccatcgccgcttccatgatgtcttttttctgatcagccggattgctgagggtcatgcttcttgtgaccgttttccaatccgcataccgaatcatgatgaacagccggcaggccatgacctccttacgctggagccgttcgctcacagacagcgcaagccggtcaaacacgcccgttaattcatcccagtcagccgaatcatgcgacagggtggatgagttgccgacgcttttaaattcataaatccgctcgggattgacttctgcaggatggatgccgttcgctttatccttcagcctcgggccgtttatgccgagaagcgttttcagcgcatgttcatctccttttgccaaatcaccgatcgttttgatgccgagcgtttttattttttccgcagttttcgttcctataccgtgcatctcttctatcggaagaggccataagacgtccggcagctctctttttcttaaaatggtgatgccgagcggttttttcatgtcagacgccattttagcgagaaatttattcggggcgatgccgatgcttgacgggagcaaaagctctttttgcagtctcgcctgaatgtctgcggctgtctcatacgccctgtgtctgtgcggtgtgtccgtaatatccatgtatccttcatcaatagaaacaggctcgactaaatccgtatactccctcagaatgctgaacatttcttttgacgaactccgatagcggtcaaaattcggaggcacgacgatgagttccggacagaggcgttttgcccgccacaccggcatggtggtctttacgccccgcgctctcgcttcgtagctgcaggtgacgatgattcctttccgttccttcacgtttccggcaacggcgataggttttcctcttaaagacggatcatacgccatttctacggaggcataaaaactgttcatatcgatatgaaatataattctcccttttccggccactcccggcgcctcctttcctttcatagacaaccttatatatatgtagtaaaataagagctgaatggatgtgataaaatgattcttgagtcaatgaatgactttttatttttagtcgattttttcacaattattcttcccgctctgaccgcgatcggcatcgcttttcttttgcgtgagcgccgcgcaggcgagcattggagaacgaaacgaatagatgaacatcaagcagtcgttcagctgaaccgaacagactttcttattattatatatcatcgcattacaacttggatacgtaaagtcatccgcatgaattcaccggcgaatgatgatgaagatgtcagcttcctccttttataacggcaagtgaagatataaaggaggaaacataattgtctaaaacatatcaaaagtggatcgtattgggattattttttatcgtactgtgcacaggccgctcggcttttgcggcgacatctcagactcagacgggaggcctcgggaatatcggttttttccacgattacctgatcgagccgttttcggcacttttaaaaggggtggcgggcctgttccacggtgagtacggactgtcgattattctggtgacgattatcgtccggatcgttgtattgcctttgtttgtgaaccaatttaagaaacagcgggtgttccaggaaaaaatggctgtgatcaaaccgcaggtcgacagcattcaggctaaaatgaaacaaacgaaagatgcggaaaaacaaaaagaactgcaaatggaaatgatgaagctttaccgtgagcacaatctgaatccgatggcaatgggatgtcttccgatgctggtgcaattcccgattttgatcggtttttattacgccatccgctcaacgccggaaattgcttcacactcatttctgtggttcagcttagggcattctgatattcttgtatcactgtgcgcgggggccatgtatttcttacaggcttatatttcccaaaaattaaacgagaaatattcaccggctgctcaaaatccggccgcgatgcagtcagcaaaaatcatggtctttattttccctgtcatgatgaccgttttttcgcttaacgtaccggctgcgctgccgctttactggtttacaagcggactgtttttgacagtgcagaacgtacttttacagcagacgcatcataaaaagaaacaggctgcggctcaggcggagcccgccaaatcataatactgaaaccctgccggaacctatccggcagggttttttcttgtatctgcaaagctttaagcctaatatcatgaagaatgaaaaaagcacccaatcaactgggtgcttcgtttttagttggccgctgtttcgataatggcaacgaccatttctgccgttttgacgagctcttcaatcggcattttttcatttttcgtatggatttgttcatagcctactgacaggttgactgtcggaatgccgtggccggcaatgacgtttgcgtcacttccgccgccgcttgtctgaagttcgctcggacggccgatttttgccgccgcttttttcgcgacttccacaacctgatcgccgtcctgatatttgaaacccggatacatgaccgcgatgtccacttccgcgcggcctcccatctcagctgcagcagattcgaaagcttctttcattttctgcacttgcgcttccattttttcaggcactaatgaacgcgcttcagccagaatatcaacctggtcgcagacgatattggtttgcgtgccgccttcgaaacggccgatattagccgttgtttctttatcaatacggccgagcggcattttagagattgcttttgatgcgattgtaatcgcggagatgcctttttccggttctacacccgcatgagccgttttcccgaaaatggttgctctcactttcgcttgtgtcggcgcggctacaataatgttgccgacttttccgtctgaatcaagcgcaaaaccgtatttcgcggtaatgtctgaacgatccattgcttttgccccgactaatcccgattcttctccggccgtgataatgaattcaatggtgccgtgctcgatgttttgttctttcagcactttaatggcttcaaacattgcggcaaggcccgtcttatcatcagcgccgagaatcgtcgtgccgtcggattttacatagccgtcttccacaatcggcttaacgcctttgcccggaacaaccgtgtccatgtgggatgtaaaataaatcgtatccgcatcttttgtgccctttaacgtacagattaagttgccggctccatgccccgtcacttcttttgtatcatcttcttttacgctcaatcctaaatcagtgaatttttgtttgagcaccttgctgatttccgcttcatgttttgtctctgaatcaatttgaacgagttcaagaaattcttcaagcagacgtttttcgtttaccattttcagttccctccgtttaaagcggtatattaccgtgcttttttttcggtctttcctcttccttatgcgcaagcatgtcaaatgcctgaatcaattttttcctcgagtcttccggccggatgatatcatccaccataccgcaggcagccgctttatacggaccggcgttttccttttcgtatatggcttttttttcgcgcttcgttttctccgggtccccagaagcctgtatgtctctgctgtataaaatcgacgccgcgccttccgctcccatcacggcgatttccgcattgggccaggcgaatacaagatctgctccgagccctttcgaattcatggcgacataagcgcctccgtaagcttttctgatgatgagcgtcactttcggcaccgccgcttcggcaaaagcatacagcaattttgctccgtgacggatgattcccgcatgttcctgctgaaggcccggaagaaatcccggaacatcagcgatcgtcaatagcggaatatgaaacgcgtcgcaaaaacggatgaatctcgacgctttgtcagcggcatcaatcgtgaggctccccgccaagtgtttcggctggtttgcgacaacaccgactgtacgccgtccgagtttcagaaaaccgacagcaatgtttttggcaaaatacggctgaatgtcaaaaaacgttccgtcatccgccagctcttttattacctgtaacacatcgtaaggtttcgaactgtccgcgggaacgagggtgtttaataacggtctggcgtcttcctttttaacgggtagtgccgtctgtccgccgtgcgggagataagaaagcagggttttcacagccgaaagtgcctctttttccgttcgtgcggaatagtgggcatttccgcttatcacattatgtattcccgcaccgcctaaactttccgcgtcaatctgttcacccgtcacctgttcaatgactttcggacctgtaataaacatgtgcgacgtatgttccgccataatcacaaaatccgtcaaagcgggtgaataaacagcaccgccggcacacggcccaagaatgacagaaatttgcggaatcactcccgagtaaaggacgttgcgcctaaagatatgaccgtatccatttaatgataccacaccctcttgaattctcgcaccacctgagtcgttcagcccgatgatcgggtttttgtttttcgccgccagatccattaccgccgcgattttttccgcatgcgtctcgccgagcgtcccgccgagtacggtaaagtcatgggcaaacaaatacacgggccgtccgtcaattgtgccgtatccggtaacaacgccgtctcccggagcattctggcacccgggcgtgcggcttttggcaaacggctgcagctctgaaaaactgtcttcgtccaatagatagtcaattctttctcttgccgtcagcttgccttttttgtgctgttttttatttttttccgctccgccgccgtttgttaaaaaggaacgtctttcgtttaagtgtctgatatgatcactcatgttcatcttgagtttctcctttttcaattgtttcacaaagctcaatcaggacgccgttcgcctcttttggagagagaaatgcgatcttcttcccgcccgctccgttttgcggttcatgatgaagcaaggtcatgcggcatgattcaagctccttgatcgtttccttcatatcggcgcagcggaatgccaaatgatgcagcccttcgcctcttttctgtaaaaaagagctgacgggagacgcgtccgacagcggctcaatcagctcaagctttgtgcctcccgcttctaaaaaagcaactctcacattttggccgtttaccagctcgtctcccatatacgtaagcccgagcatccgttcgtaaaatcctctcgcggcttcaatagagctgacggcaatgccgacatgatcaagttttttcatagcgcggccacctgctttcccccataggatatggcttgttcatataagcaaaacacgttaaaatggtagacagtaatcttaaggagtgaaacaatgtctcaaaaatttatgaaaagcgccgtcatcgtcattttgggcgtatttatactttcaaccctcctctcaggcattatgatgtatttgcagtaaaaaagcaggcgcctcattgcaagggggtttcctgcttttttatgagggctttccgctctattgcaatgtcctcgaatgagcggttttcttttgtaatcaatactttcgttccgggagggataatccggaaaatacggatgacatcccggtttttcatacggatgcagccgtttgatacaaaccccccgatcagctcttctctgtttgttccgtgaatgccgtatattctgccgtcggtgcctttcgcatcaaaaccgatccagcggacgccgagcgggttttccggcgcgcctccctctacatttttcttccggtaatacggattgacggctttgaccgttaccgtaaattctccttcaggcgtcaaatcatccgtttttcccgtcgccacctgataaatgccttctattcggttatcctttacaacagcaagcgcatttgtggctttattgacgataatataagggtcacccggcaaagggttcgcgccaagcggccaaagcggagacagcagcaggacggctgacaataaaaaaaatcgcatgggctcccctccttttttcattagaatgaccaatgaaaggaggactcatgcgattgatccatatgttttttacagcttgatgcctttgaaataacttttaatcacgagatattgttccatctcaccgaggaggtggaacaaagccgcccgcgcttcaaactcctcacgcgttgccgggagcggcatttcttcaaattccgttctcatttctgcaagtctttttaaaaatttatgagcggtattgccgggatgaatggcttcccttaattcatggatgaaatgggcgattatttttccctgctccaccgttattgaaatagaggtaatcttcggcagcagccgttcaatgatttcaaattgtttctgcctcatcttaaaataatgatagtagagattttcatggcgcaaaatatgattctgcacgtcccgataggcgaggtttttcgcctcttgaatcatctgatgcgtctccggtatttccttccctgtccaatcttgctcaccagttaacaaataccgttcgatttcggcgaagatgacggaaaagttgtcctcgatttttttcctgtacgctgcgagttttctgtcgaggctcggcatatacagattcattaacagcgcgacgccgatacctacggtgatcagctggaactcattccagataaacgccatcgtaatgccgccggacatatataaatgaagaatgattactgagctggtgacgatcccttcatttatttttaaaacgactgtagtcggaatgaacagcaccagcaatattccgatcgcaaacggataatagccgatcagtccgaaaaagacatatgaaaagacgatcgccaataaacaggcggcaaatcgggcccacgaggcctgaagcgaccgcttttgtgtaatctggatgcacaatatggtgatgattcctgcggatgcgaagttttgcagatgcaacagctgggctaaataaatggccagcgccgttccaagtgcggtctttagtgtccggtaaccgattttaaacattgcttgctccattctgtttgtttctttctcaaaaaaaagaagaagagcattcttcttcttttcttacagttatattttataatattttttctaaaaagtcctgtgctctttttgacttcggagaaagaaaaaattcttccggctgaccgtcttccacgatcgtcccttcatccataaataatacgcggtctgcgacttctttggcaaatcccatttcgtgcgttacgatcaccattgtcatgcccgtctgcgcgagctctttcatcacctcaagaacttctttgaccatttccgggtcaagagccgaggtcggttcatcaaacagcatgatgtcaggattcatggcaagcgcccgcgcgatggcgacccgctgcttctgtccgcctgacaaacggttcggatagtcgttccgtttgtcaagcagcccgactttttcaaggagagcgcacgccttttcctccgcatcctttttagactctttcttcacgctgaccggcgcgtatgtgatattttcaagcaccgttttatgaggaaacagatgaaaatgctgaaataccatgccgatattttcccgcactttcagtttattcgttttagctgcggtgatttcgttttctttaatggcaatcgttccgccgctcggggtttccagcagatttaagcagcgcagaaacgttgatttgccggaaccggaagggccgatgacggcgacgacttccccttcttcgatctgtgttgaaatgtttttcagtacttcatgtttcccgaatgattttgacaggttgtcgaccttaatcattggctttcagcttcctttctacgccttttccgatgaatgctaagatcaaaacgagcacgtaatagattaagcccgccacaataagaggttctaaatagttgtatgttgcggcgccggactggtaggcccgtctcataatatcgccgagaccgattaccgtgacgattgccgattctttcgtcaaggtgattaattcgttaataatagccggagaaatgtttttaaacgcctgcggcagcagcagatctttcatcatttttccgtacggcacgccgagagcgacggcagcctctttttgtcctttgtcaattgcgttgattcccgctctgataatttcagagacgtaagcggctgaattgagcgataatgcggtgaccgccgcccaaaattgatcgatctgaaagccgagaagctgcggcataccgaaatagatgatcatcagctgcagcacaagcggcgtgccgcggaatatcgaagtataaaaatccgcaatccatttcagcggactgatcgtgctgattttaaataagctgagcacgattcctaatacaagaccgatgaccgctgaaacgagcacaatttttaatgtgaccgcaaggccttccaatataaaaggaatttgggggattgtcgctgagaaatccaaattcatacgtgtgatctcctttgtctttattcaagataaaaagctcaacgaaaagttgagcttccttttatttctcgttggtgaaccattttttcttcagtttttcgatttctccgtttttctccatttctttcagcgctttgttaaacttcgctgtcagatcactgtctttgcggaacgcaatcgcggagcccgattcgtctgatttcgcatctgctgacgcaaagccctgcagatcgttatttgaactgaaatagccttgtgctacgatgtcttcgataatcgcggcatcaaaacgcccggatttaatctcttccgttaagtctgagatccggttgcggtcttcgagctgaaaaccgtatttcgaagcgagcttcttgcctttttcctcttgaatggagccgagctgaacaccgacggttttgcctttcagatcattcagggatttaatgctgcttccctttttcgtaacaatcatattgttagcagtataataaatatcagaaaaatcaacttgctttttccgttccggcgtaggtgtcattccagataaaatcatatctacctgcttggacttcaaggctgtaatcaggctgttgaagtccatgtcctgcacctcaacgtcatagccggtctttttgcccagagcttttgccagatcaacgtcaaacccggtgatctgatcgccgtctttatattcaaatggtttatagtcagccgatgtacccataatcagcttattctttccgccctctgagcctgaattgcctgatccgcaggcggacagcgcaaaggtgatacatgcggcagctaataccaacagccatttcttcatgattcatttcccccatatctactgatctcttaaaattgaatatttattcgttaacttgtattttaaacactttttaattgtgatgcaatactatttttgaaaaatatattttcctttctctgtttattatagtcattgtttttccgattagtgacagctgaacgccggtgtataaatatttatatttatacagattccatataaaaaaccccggaagcgctcggctccggggtttttctttcacttatacttcttcacaatattcttcaaatgcttcctgcagttttgtgacgacggccatcggctcatggccttcaatttcatggcgttccaccattttcatgattttcccgtcttttaaaatggcaaatgacggagaggacggcggatagccttcaaagtattctctcgctttggctgtcgcttctttatcctgtccggcaaataccgtcacaagctgatccgggcgtttatcgtaatgtacagaatggtatgcggcaggccgtgcaataccgcctgcgcatccgcacacagagttgaccatgacgagtgtggttccttttttcgaaagcgcttcgtccacttcctcagcggttttcagctctgtatacccggcggccgtgatttcctggcgggcttgacgcacgacatcattcataaataaattaaaatccatattcaactgggacctctcctttttgatcatcttttcttatgatagcaaggaacctcactatcggcaaatgacaccgctcatatccaaattgttttttgttccttttatgtacctgatgtaagtttatgaccttttaaaaacgggaaacttgttaaagagattgtctgaaataaaggagcagtcgtatgagccaacggaaagcagtattaatttataacggaaacgccggtcaaaaacagattgataaaacgctcggcacggtcgtccccattttggcccagtcagctgacgaacttttgattaaaccgaccaaacatcaggacgatgcccgtcagtattgtgaaaacctcgacagttcagttgaccatttatatattttaggcggagacggcactgtgcatcaatgcatcaacagcatcagcaagcttgataacaggcccgctgtcggcattttgccgggaggaacgtgcaacgatttctcacgggcgctcggcatcccgcaaaaccttcaaaaggccgctgaagcgctcgcggccggacataaacggatgattgacgtctgtaaaacggatgacggctattttctgaacttctggggcatcggattgatcaccgaagcatcgagccatatcaatgaaactgaaaaagcatggcttggtaaaatcagctacttcacgagcgccttgcggacgatgacaagtgcgaacccgtttcctgtcaaattgacaattgacggcgaggtgaaagaagacgaagccgtaatggtgcttgtcatgaacgggcattatatcgggacaaacagagttcccctgcctgatgcgagcctccgggacggcttagccgatgtgttaatctgccgcaacacaagccttgccgcgttgcgggagctgatgacgatggagcagggttcgtttgatgatttcaaaggggagctgtcctatattcaggcctccaggattgaaatcgaaaccggacgtgaaatggacgcggatacagatggcgaggtatacggaacaacgccttgtacgatcgaagtgaaaaaacatcatctcactatgcttgttcccgaggattcacaatgaaaataaaaaaactccttttgccgcccgggcaaaaggagtttttttaatagactgaagtattttcgtcaatgttttctaagatttctttgacgcgtccgaggaaacggccgcatacgagcccgtcgagcactctgtgatctaaagacaggcaaagattaaccatatcacgcactgcgatcatcccgttattcatgacaaccggacgtttgacgatagattctacctgaagaatcgccgcctgcggatggttgataatgcccatagattgaactgacccgaaagatcccgtgttattgacggtaaatgtgccgccctgcatatcttccgcggtaagttttccgtttctcacttttttcgcaaggtccgttatttctctggctatgcctttaatcgttttttcatcagcatgcttaataaccggaacaaacagcgaatcttccgtggcaacggcaatggagatgttgatgtctttcttttggacgattttgtctcccgcccacatgctgttcatctgcgggaactctttgagagcctgcgccgccgcttttacaaagaaagcgaaaaatgttaaattgaagccttctttttgtttaaatgagtcttttatgctgtttctgtacgccgtcatgttcgtgacgtcgacttccatcatcgtccaggcgtgcggaatttctgttttgcttttatgcatattggcggcgatggcttttctgacgcctgtaaccggaatttcaatatcaccggctgacagaactggcgccggcgcttgtttttgctgttgtttcggcgcttgttgcgttgtttgaacggcagccggcgccggtgcttccgacttctgctgcattcccgaatcaatgatcttttgaatgtcttttcgcgtaattcttcctcctgcgcccgttccttcaacttcttcaagctgaatgccgtgttctcccgctaatctgagcacggccggcgaataacgcgctttatttgactggtctttaccttgacggtttgcatcggtgtctgaaggggtattctgctcttcttcccgcttcggcgcctcttcggtttccgtttcttccgtttcaattttgcagatgatctcgccgactgtaagagtctggccttcttctcctacaagttctgtaatcgtaccggtaaaagaagacggcacctccgcattcactttatccgtcatgacctccgcgatggggtcatatttattcacttgatcaccgggggataccagccatttgctgatcgtcccttccgtcacgctctctccgagctgaggcatagccatttgttcaatcgccatgtcaaaaacctccttacgtctttaaaactccgctaattctctcatcgcggcttccgctttgtcaggattcatcatgaagtatttttccattgtcggcgcataaggcattgccggaacatcagggcctgcaagccgcttgatcggcgcgtctaaatcaaataagcagttttcagaaataatggcggcgacctcgctcataataccgccttctttcgtatcttctgtgatcagcaatacttttcccgttttagacgcggcttcaatgatagcctctttatctaacggataaaccgtacgcaagtctaatacgtgcgcggaaattccgtctttttcaagacgctcggcagcctgcagagcgaaatggacgcataatccgtacgtaatgacagtaatgtcgctgccttcgcgttttacatccgcctttccgatcggaaggacgtaatcatcagcagggacttctcctttaatcaggcggtacgccctcttatgttcgaaaaacagcacgggatcttcgtcacggactgcggctttcaacagcccttttgcgtcataaggagttgaaggcatgacaattttaagacccggctggttggcaaaaatggcctccacagattgggaatgatacaacgcgccgtgcacgccgcccccgtaaggcgctctgatgaccatcggacagctccaatcattgtttgaacggtagcgtattttggccgcttctgaaatgatttggttgaccgcaggcagaatgaaatcggcaaactgcatctcggcaatcgggcgcatgccgtacatcgcggcgccgattccgacacccgcaatcgctgattccgcaagcggcgtatccatcacccgctcttctccgaactgttcatagagacccgccgtggctttaaatacgccgccttttctcccgacgtcttccccgaggacaaaaacgcgcggatctctttccatttcttctttcatagctgcattaatactgtcaatataagacattacagacataagtattcctccctacttcgcataaacgtgatcaagcgttgattcaggagatgcgtatggcgctttctccgcttcgtctgtcgcttcgtttacgatagccatgatgtcatccagcatggccttttcttcttcttcacctagaagcccggcttcttgcaagtatgctttgtataaaagaagcggatcctgtttctttgcttcttctacttcttcgcgttctctgtagctgctgtcgtcgtcatcactggaatgcggcgtcaaccggtaggaaaccgtttctattaatgtaggaccttcgcctttagatgcccgttcgcgcgcttctttcacggcccggtaaacttccagcaggtcgtttccgtcaactgtgactcccggcatgccgtagcctgccgcccggtcggaaatattttcgcacgccacctgtttgtcatacggaacggaaatggcatacttattattttcacacatgaaaatgaccggcaatttatacacggcggcaaagtttgccccttcgtgaaaatctccctggttggaagaaccttctccaaaggtaacgaaagagacgatatcctttttatccatgcgtcccgcaagcgcgattccgaccgcgtggggaacctgcgtcgtcacaggggatgagcccgttacgattctgttttccttttgcccgaagtggcccggcatctgccttccgcctgagttcggatcagccgctttcgcaaaacccgacatcatcaaatccttagcagtcataccgaatgcaagcacaacccccatatctctgtagtacggaagcacatagtcggtatcgcggtttagggcataggccgcgcctacttgagccgcttcctgcccttgacatgaaataacgaacggaattttgcccgagcggtttaagagccacattctttcgtcgatttttctggctaacagcatggttctatacatttcaacggcttcttcgtcagaaagccctaatgcttgatggcggtttgtagtcattcaaacccctccttctttccttttaaaaatgaatcgcgtttccgtctgcggctaacgcagcttccccaatcgcttctgaaagcgacggatgcggatgtatggactggccgatttcccaaggcgtcgcgtcgagcaccttggcaagccccgcttcagagatcatatcggtgacgtgcgggccgatcatatgaacaccgagaatatcatctgtattccggtcggcgacgattttgacaaagccatcgctttctccgtatacaagagcctttccgattgccatgaacggaaactttccgatcttaagttcatgtccttttcgggcagcttcttcttctgtcagaccgacactcgccgcttccggatttgaataaatgcatttcggcacaagagcggcatcaagcggagccggattaagacccgccatatgctcaacggcaatgatgccttcacgggaggccacatgcgcaagctgcagaccgccgacgacatcaccgatcgcataaatatgcgattccttcgtctgtccggcttcatttactatgatagaaccgttttccgctgcaatgtccgtgttttcaagaccgatcccttcaatgttcggctggcggccgatggaaacaagcatttgttcggcgtgatacgtttctttttttccattcttttcagcggcaattgaaacgccatccgctttttccaatgtatccggaagcactttcgcacccgttacaatcttaattccttttttcgttaacagtttttccatctcgcttgaaatatcatggtcttcagtcggcaaaatgcggtccgcatattcaatcacagtgatattgacgccgaaatcgttcagcatggatgcccattcaattccgatgacaccgccgccgacgatcaacatggattggggcagacgctcaagctcaagcgcttcatctgatgtcagaatatatgtaccgtctgcttctaaacccggcagcattttcggccttgaaccggttgcgataatcaattgtttcggtatcagcatgtcgttttcttcaccatttgcgtattcgacggaaaccgtaccgggaagaggtgagaagatggaagggccgagcatacgtccgtacccgttgaatacatcaatcttcccctttttcatcaagtgggcgacaccgccggccagccggtcaacgattccctgctttcgtttttgcacgctgtcaaagcggagggagacaccttccgtttcaatgccgaatgctgccgcttcctttgcggttcggtacacttccgcgcttcttaacagcgctttactcgggatacatcctttatgcaggcatgttccgccgagcttttctttttctacaacggccgtttttaagccgagctgggccgctctgatggcggctacataaccgcccgtgccgccgcccagaatgaccacatcatattcagtcgccatttgttttcactccttcgccgatctgatattgctttgactgctcctcgccggctaaaacccgaagcgcgccttgcgcgagagattgcagttcattttctcccgggtacaccagtacatccgaaatccaatctatgtacgatctgatggcggatacgaaacttttcccgtacgccaatccgcccgtcaggacgataatgtctacttttccttttaatacggcgcttgccgccccgatttcttttgctacttgataagccatggcgtcataaatgagcctcgcatgctcatctccggcctgaatgcgtttttccaccttcaccgcgtcagttgtccccaggtagccggagagtccgcccgtgccgacaagttttttcatcatatcggcttttgaatacttgccggaaaaacacatctccaccaaatcacccgcaggaacggttcccgcacgctccgggctgaagggcccttctccgtgaagcccgttgttgacatccgtcacccgtccgcaatcatggaccccgactgtgatgccgccgcccatatgagtgacgatcatcttcatctgttcataccgtttgccgagggacgccgccgcatgacgggcaacagctttttggttcaaagcatgaaaaatgcttttccgcttgatttcaggcattcctgatactttagcgagcggagtcatctcatccaccacgaccggatcgacgatatacgcggggatatttaatccgtctgctatttccctggcaataattccgcccagattagaagcatgctggccgttgtagccgtttttcaaatcagtgatcatggcgtcattcacttcatatgtgccgccctcaatcggtctgagcaggccgcccctggcacaaacggcatcaaactttgaaatgttgatgccctgttcgtgcaaagactcaagaatgcttatttttcgaaattcgtattggtcgataatgccgttaaatgctttcagctcttcttcgggatgccgcagcgtcttttcaaagatacagcgttcattgtgaaagacaccgattttcgttgatgttgagcctggattcagaatgagaatgcgtttttcctgttcgaacattttcatacctccagatcaaattcctatcgtctgcttaatatactttggccgttttgcagaaactggcttcttgaacggcgcatgcgctcaattcgttcctcagccagacggtcggccgctaagtatgtcggaatgccgtcacgcgcggaaatatcgagcacccgctcaatgtttgcatagatgccctcaacctttttcaaagcacgctcagcgttgtagccgtaaagctcatcggccacattgatgacgccgcctgcattgatgacataatccggagcgtacacgattcccatttcatgaatggtatcgccgtgacgtgtttctttcagctggttattggccgcccccgcaatgactttcgccttcagctgtttaatcgtgtcatcgttaatgacggcgccgagagcacacggggcataaatatcgcacgcctgtgagtaaatgtcgccgggatcaacggcgcgggcgccgaagtcctcaacggcacgtttaacagattctttattgatatcggttacgattaaagaagcgccttcttcgtgaaggtggcggcatagattgtaagccacatttcccacgccttgcacggcaattgttttaccttccagtgaatcagtgccaaacgccgctttcgctgcggctttcatccctttgtagacgccgtacgccgtaaccggagacggatttcctgatgaaccgaatgccggagaaattccggttacatagtctgtttcatcatgaatgatgtccatatcttcaacggtggtgccgacgtcttccgccgtaatataccttccgtttaagccttggatgtagcggccgaacgcgcggaacatttcttcatttttatctttgcgcgggtctccgataataacggttttcccgccgcctaagtttaaaccggcagccgcatttttataagtcatgccttttgcgagtctcagtgcatcttcaatcgccgcttcctcactgtcatatgtccacattcttgttccgccgagtgcagggccgagcgtcgtatcatgaatcgcgatgatcgcttttaatccggattgttcatcttggcagaataccaattgttcgtaatcataagtctccatatatttaaaaatttccataggttcgttcctcctactgttcttgtgatgcgcaaatcgcaagcgcaattgaatacagtttattttctgcggtatccgctctgctcgttaatgcaatcggcgcttttgcaccggcgatgacagcagcaacatttgctttcgcaaaataaatcattgacttataaagcatatttccggcctcgattgaaggaaccaagagaatatccgcctggcccgctacgcttccggaaatccctttttgcagcgcagccgcttgggatacggcattatccaaagcaagcggtccgtccgcaatgcagccggtaatctgtcctctattgcacatctggacgatcgcagccgcgttcagcgtcgcctccattttcggattaaccgtttcaatagccgcaaggactgcggctttcggcatagggttccctactgaatgtgcgacatgaaccgcattttgcagaatatgcccgagctcttcaagagacggggcaatgttcagcgctgaatcagtcacatacatcagccggtcatagtccggcacttcaaaaacggctacatgtgataacaccctttttgaacgaagcccttcctggcggtttaaaaccgatttcagaagagttgagctcgggagattccctttcattaaaacgtccgcctcttgttcacgcactgcgcgcactgcttttgccgcagattcttctggtgaatcggcgtggatgatgtcagcattgaacttcggctcatttgccagaagctctttcagctttccgctgtcacccgtcagtaaaaatcgtgccgacaagtgttctgccgccattttgacggcgtggatcacttctttatctgctgcgtgggccactgcaatggtttttgcgttttttgccgcggctttttcaactaggtctctcagcttcattttgtaccacctttcttgtgcgaatccgcttttaacaatgcaagttctgtgccaaatatgcgaaagggtttattccggcttttttcaagaaaacatgcagcggtttgcgctttctctgcaatttattgcatgccgtcatttgcaaggccgtacttgtccattttgtagtacagattccgaatgctgacaccaagcgctttcgccgttttggttcggttgaatttatgcttttcaagcgttttttgaatgatgtgcgcttcaaatttttcaacagcctgagacagcttttccccttctacatccggaaaatcactttgggtgccgtttttgtcattcagctctgattcgaaaacaggcagatgctgctgttcgatccgttccatatgcggctctaaaaatatcattgcccgtccgagaacattttcaagctcccgtacgtttcccggccagctgtaggctgataaagctcgcagcgcgttcggcgtgagcccctttacattgcggccgtaatcctgattgattttttcaatgagccgaatgctcagcgcttcaatatcttctttgcgctgccgaagcggcgggattgagatcggatagcggttaatccggtaatacaggtcttcgcggaacgcgccttccgccatggccttttcgatgttgacgtttgtcgctgcgataattctgacattgacagaaatcgcttttgcgccgccgactctgataatttctttttcctgcagaactctgagcagctttgcctgggtgctttgggtcagctctccgatttcatctaagaaaatgctgccgttattcgcttcctcaaaaagtccttttttgcccccgcgcctcgcgcccgtaaacgcgccttcctcatagccgaaaagctcggattcaagcagggattcagacagggccgcacaattgacccgaatgaatttattgtattttcggtcgctttcattatggatggcgtgggcgaaaagttctttccctgtgccggattctccccgcagcagaatcgtcgccggcgttttcgccccgagcttcgcctgttcaagggcaaccagcatttgttcactcgtgccgataatgtcatcaaacgtgtatttcgcttcaagcgtgcggatgatctggcgcgcccgattcagctcagcagtcagcgttttaatttctgacacgtcgtggatgacgccgacgctgccttttaaaataccatccacaataacgggggcaacatttacgatgacatcctttttattggggccgaccttcatcctcacaccccgcacgggccgccttgtccccaatactttcaggtgcatgctttccccttctgagatatcggtggaagcgggttttccgatgacttcgctttctgacagcccggtcatttttgtatatgctttgttgattaacattccgatgccgttttcatcaacgacggaaatggcctcgtctgacgattgaataatcgcttcaagcatggtgcggatttgttttaagttcgtgacctcttccgccagttcaactgcgtcggtgatgtctttaaacacgcataacgcgccgagaagttttccgccttcatcaatgatcggcagtcttgtcgtgacaatctgcaggtgcttgccgagaagctgcttctggttatattccggctctctcgtttccagaatccgcggcagctttgtgttcggcactacatctttaatttggcggccgatgacatcctcccgttttcggccgaccattttttctgccatctgattaaataaaatgatcgtttcgttgacgtctataaaaatcatgccgtcgtgcgttgaattaaaaatccggtcatgcttatacgtctgcgacttcagcatttggataagctgctgtttttcctccatcagctgaaacaccatgtacgccaattttcccggcatgacgatggtttgttcttttttctcatggagcagctcatccatgaccgctttatcgcctgttgtatggatgataatatctatatcttcagttatgtagggtttccaatctgatgaggttgcaattccatatctccgggcttcttgcagcccttgcgcctccggatcttgatcaaccaccgcaataatccggatcagttttgttttcatcaaaatctgtaggagcgccgtgcctcctttaccagcacctataatcagcaccttctgcatcccgatacccctttatatgaaaaaatttgcacacctgtatttcccgttgcaataatttgcacaacccctatgttaccacgttttgatctcttgacaaaatattttttcgattggacaataaaggaaatcatatcgtaaaggggttttctgaatatgagccggcttgttgcgcttttgattctggtcctccccggcgctgtcgcggcgctcggcattaaactgatgagagatgcattattcgggcatgcgttttccccgtttccgtccctttttcttcagggggcggccggattggcgttttttttgttcggcctttatgttctggccgggtttattttgtacagagatcggaaacgcaatcaagtcagcccgcggttcaggaaaaaaaagctgtaaaaaaagcccttgcaaaaaagggctttttcagtcgtccggcagtatcgttttggcaatggattgatccagttcttcatagtcatcgtaagcgatcgtttcatataattcttttctcgtctgcatatccgaaagcccctctttttgagagccttcttctttcagaaggcggaaaatacgctcaaaagccttggcagccgttctgagtgacgtgaccgggtaaatgaccatctgacagcccatatcggaaaattcatcagcactgtaatacggcgtttgtccgaattcagtcatatttgcgagaatcggcacactgatttgtttggaaaacgctctgaattcactttcgtattggagcgcttccggaaaaacagcgtcagcacccgcttttatataagcggacgccctttttaatgcccctccagcccttcctgctgtctggcgtctgttctcgcaacaacaagaagagtcggcgcggcccgcttgaccgcttggattttttgcgccatttcttcaatcggcacgagctgcttcccattcagatgtccgcattttttcggcaggcgctgatcctccatttggacggcggccgcgcgcgcttcatacatttctttcgccgtccgggcggcattcagcacgcctccgaaacccgtgtcaatatcgacaaggacgggcagatcagacgagcggaccagatctttaacccgttcagccatttccgccgacgtgatgatgcctaaatcgggcagccctctgctcgccgtgtaagccgcgcctgataaataaagagccgaaaaacccgttttcttggcaataagagcggccatcgcatcgtgagcgcctggaatctgcaatagatccggcgctgccatcagcgtacggaaccgctctgcaagctcctcttgagacgactgcttgctgacgatccacgtcatgtttgtcaccctcctattttatatgagaaataagtccataaattcactaacgctgagcttctgcattcggccgctatctttacaggcctcttcgattttccgctgctgcttcaatgaaaaatgagtgctgatgtttgctgaaaacttggcaagaatcttcggaacggcttcttttctgcggaaccggtgcccgagcggatattcacattcaatccgtcccgtagccgtgccgtctgtaaaatgcacctgtacggcatttgagatggatcgcttattcgggtctaagtaatcttttgagtacgctttatgttccgtcacctccattttgctccgcaatgtatcaattcgcgggtcagacgccgtttcctcttcataatgatccgccgtgatatctccgaaaagcagcccgattgccgtaatatactggaggcagtgatcccggtcagccggattgtgaagcggcccttttttatcgataatccggattgccgactcatgggtcataatcgtgatcctgtcaatgtcttcgatgcggtctttcacctccggatgaagccggaccgcgcactccgccgctgtctgggcgtggaattcagccggataggatactttaaacaaaacattctccatcacataggacccaagcgggcgggcaagcttcatttcctgccggttaaataatacgtcttgaaatccccacccggatgcggtcagagccgtcgggtaccccatctcacctttttgcgccataagggccaaatatacgcctctgctcgtcgcgtcgccggccgcccatgatttgcgtgatccggtgttcggcgcatgacgatacgttctgaggcttgaattatcaatccaagcgtgagatacggcgttattgatttcctctcttgagccgcccagcatttgtgcgcaaacagccgcagtcgccaccttcacaaacagcacatggtcaagcccgactctgtttaaactgttttccaaagcgagaattccttgaatttcgtgcgctttgatcattgcgcaaagcacatcacgcacggtaagcggttctttcccttctgaaatccgcactctggatatataatccgcacaagccaatatgcctccgagattgtcagacggatgcccccattcggccgcaagccacgtatcattataatcgagccacctgttgatacagccgatattaaaggcagccgtgaccgggtctaaaacaaaaggcgtgcccgggactctgctgccgttgggcacggaggttcccgggacaatcgggccgagcagctttgtacattcgggatagctgagcgccaaaattccgcagcctatcgtatcaagaagcacatgtcctgccgtagtgaaagcttccgaactgtcaatctcctgatggagcacgtagtcagaaatctcttcgattacggcgtccattcggcggggttctgtcatgttttcatcttcctttctcatctgtttacagacgcgctccggtatagcggacacgcgggcggaaaagccggtttcggctgtgctgttcaatgacgtgggcgcacagcccgaccgtccgtgcgctgaagaatataggcgtatacagcgggatcgggatgccgagcatgtaatagaccggcgctgcgtagtaatctaagttcgggtaaaggccttttttctcccgcatgacgatttctcctgcttcacacatatgataaagacggaaatcacctgaaagatcagacagttttttcaacgcttctttcatcatgagcgccctcgggtccatttttttcatgtagacacggtggccgaagcccatgattttttctttgtttgcgagtttttgagttaataattgtgtaaacccgtctgtatccttcgcttcctcaagcatgtacataactgcttcgttcgctccgccgtgaaggtttcccttaagcgaggcgactgctccggtcagagcgccgtaaatatccgattgcgtcgaagcaatgacacgggccgtaaacgttgagttcggcaattcatgctcactgtataaaagaagcgaccggtcgaatatttcttcttccaaggaggacggcgtttttccggtaatcatatataaaaagtttgcgctgtacgacaaggttccgacaggcgctaaaggctccagtccgttgatgactcgatagctgttgacggtcagattgggcattttgcctatcagcccgcggacacggtgccgatttacagaagaggtgcggttatcaatatccttatcaaagcctccaagcgcggacaaacctgtcctcagtccgtccatcgggtgagtacgttcgggcagcagacggcatatacgcaagatttcctcgggaaggtgtccgccgcgccgaacgtcttcttcaagcgccttcttctctttcgcatcaggaagtctgtcttccaataagagatgaacaatgtccatatagccggccgttttagaaagctcaatcagatcgtggcctttgattaaaatactgccctgctgtgtatccaggaaagaaatccccgtttccaccgcaatgacgccatctaaaccgggagaataagattccatagtttcgctcctttgcgcactttttattgaagaagatacttagaaataatcagcctttgaatctcattggttccttcatagatttgcgtgactttcgcatcccgaaataaacgctccgcgggatactctttcatatagccgtagccgccgtgaatctgcacagcctccaccgccgctttcatcgccgcatcggacgcgaattgcttcgccatagatgcttcttttccgcacggaagccctcgctgatacagatcagccgcatgatagaccaataatttggcagcttccgcattcgttgccatgtcagataatttaaatgaaacggcctgattcgaagcgatgggtctgccgaactggctgcgggttttggcgtactccgccgagcagccgagcgccgcttcgataatcccgagcgcctgagccgctatgccgatccgtccgacgtcaaggtttttcatggcgattgaaaaaccctcgccctcttcgccgagccggttttcaatcggaatttccgcttgatcaaactgcaattcggcagtattggaacctaacaatccgagctttttttctttttttccgacagaaaaaccgggtgtgtttttttcaacaataaacgctgaaattccctttctccctttacccggatcggttacggcaaatgtcagatacagatctgccgctccgccgtttgtaataaagatttttgaaccgttcagaatatatgaaccgccttttcgcacggctgttgttttcaggcttcccgcatcagatccggagtgagtctcagtaagcgcaaaagctccaatatattcgcccgctgccagcttcggaatatacgtttgtttttgggcttctgtcccgaaatgcaaaatcgggattgtccctaccgatgtgtggacggacaaaatgacgccgacggccgcgctgacttttgatatttcatgaatcgctaaaatgtaagatgttgtatcagcacccgccccgccgtaagcttccgggacgggaatgcccatcaatcccgcttcgcccatttttttaatcagccgctccggaaattcatctgttgattccatgagctcaaccatcggtgcgatttccttgcgggcaaaatcacgcaccattttcctcatcatgatgtgctcttcagtaaaatgcatggctgccgtctcccctcatgatctttacgtcatctgccgtactcataaaaaccgcgcccgctttttttgccgagccagccggcgctgacatattttctgagcagagggcatgggcggtatttcggatctccgagccccgcgtagagaacctccataatggaaaggcacgtatccagcccgatgaagtcagctaatgttaaaggacccatcggatgacgcatgccgagcttcatcacctcatcaatcgcttcctttgaagctgctccttcgtaaaggcaataaacggcttcgttaatcatcggcattaatatgcgattagatataaagcccgggaagtcattgacttcgacaggggttttattcatccggacggcaagcttctttactgtttccgccgtttcttccgatgtggcgagtcctctgatgacttcgacaagctccatgaccggaaccggattcataaaatgcatgccgattactttttcaggcctttttgtggccgcggcaagctccgtaataggaagagaagacgtattgcttgccaatacggcatgagggggacagattttatcaagtgtgtcaaacaattccgcttttgcttttttgttttcggcaatggcttcaatgataaaatcagcatctcccgcttctgtgagctccgccggggaaatacggctgaaaacggcatctgtctcctgctgtgacttccgtccttttgcctgctctttctccaggtttgtctttatgcggtgaagaccttttgttaccgtttccggctcccaatcgtataacttgacggcaaacccggcttctgcagccgtctgagcgatgcctgcccccatctgaccggcacctgcgaccatgattgttttcatcttcatccggcgctccctcctttgatcagtacacctccagcaggacggcatctccttgagccgctccgctgcatatagccgctatgcctaaccccctccgcgacgctttaattcgtatattaaactcatgacgattctcgctccgcttgcgccgatcgggtggccgaacgcgattgcccctccgtttacattcactttctcccggctgaacccggctattttttcactcacgagcacgacggacgcaaatgcttcatttacttcaaacaaatcaatatcgtcaacggacagtccggtttttttcaagagccggctgatggcctctcccggcgcgcttgccagctcggacgcttccagtccgacggacgcaaagccaagtatcgctgcgagcggcctgacatgctgctttgctgctttttcctctgacatcagcacaaatgctccggccccgtcatttacaccgggagcgtttccggctgtaaccgttccgtcggctgtgaaaatcggcttgagcgctgcgagctgctcaaggcttgtatcaggacgcagcccctcatccgcttcaacgatatgctgtttgccctttttgccggtccaggtgacggggacaatttcttcacgcaatttgcccgcatcagccgcctcagccgcgcgtttctgactcaaaagagcgtaatgatcctgttcatctcgggaaatgccgtactttttggccgcagtgcttccgtggacagccatatgcacctggtcgaacgcacaggtcagcccgtcatgaaccattaaatcctgaaaaaccccgtcccccatcctcacaccccagcggccggccggaatggcgtacggaatgttgctcatgctttccattccgcctgcaatcagcacgtccgcgtctttcgcccggatcatttgatcacagatggtaacggctctgagccctgatgcacagactttattaatggtttcagccggaacagaccacggaagcccggcatatcttgcagcctgccgtgccggaatttgcccggcacccgcctggacgaccatccccatcaccgctccttccgcttcgctttcactgatagcggcgcgcttgattgcttcttttatggcaatgccgccaagctcggatgccttcacctcttttaatgcgccgccgaattttccgaacggcgttcttgccgcactgacgataaccgtttttcccacaattttgcctcactttcaataagataaaagataacgcttacacaaaacgccctgttacaatatatgaaccggctgaccgagttatgagtgcaccgcctttttcccgcccataaaaaaagaagactgtctgaccagtcttctcagctgcggcattcttcttttatagaaacagccagctttggataatctgtaaaaatcgcgtctatccccgctttcatcagccgcttcatatcctcaggacgattgacggtgaacggacggagcgccgcttggtgttttgcaagatgtgtgatcacttcagcgctgaccgccggcgtgccgagcttcggatgataacccgaagcgggaatggcggcaagataacgttcaggccggtacagcacatccattgtcagcaccgcccgttcaatttcaggcgccagggcgtggcacaccgcgagactctcatgattaaatgaagaaaaaataacgcgcttttccagtccgtaatatctgacttttttgatcacttcttcttccattccttcgtaacggaatacactgtttttcagctcaatgtttatcagaaaatcagcacgttcagcaaaacgcagcacatcggacaaaagcggaattctgacacctttaaaagaatctttccattttccggcggcatcggcggttctgattttgtcatacgccgtatctttcacaaatcctttcaaagatgtcgtgcggtcgagggtttcatcgtgaatgaccacgatccggccgtcttttgtcatctgtacatcaagttcgattccgtcagccccgtcctcaatcgcttttttgaatgcgggcatcgtattttcagggcagtcgcccgacgccccccggtgggcaaaaatattcgtcatatgtgtcacctcagatgtttgtcatcggttttctctattataatcgttatgcacatcaggagggcgctatttacacatattttatcattaccgtccgctgtaataggtttcgattccgtttacaacggcgtccgcggcgtgctcttgtccgttatcgcttttcagcttgtccgcatcttgaggatttgtgataaaacctaattcagccagcacactcggcatctttgaatatgtaataacataaaaaggagcttcttttacgcctctgtccctcatccctaaagacgtgacaagctgctgctgaatgtcggaagcaagcctttcgctgtccgctccttcatatgtcgaattaaaatacgtttccgcgcccgatgccgttgatacggctgaattggtatggaggctgacgaataaatcggattggctggcgctcgctttcgccacccgctcgtccaaacgtaaaaaagtatcatcagtccttgaagctacaggttttgcgccttctgtctccaatttggcgatcaccttgtttgacaccgctaaattgatgtttttctcaagcagtccatttccgccggccccgctgtcttctccgccatgtccggcatctatatagatggttttcccttgcaaaggttcggctgcataagcggacggcgcaagcagaagcagagcggcaccgaaggcagcagcgctttttgtcagtaaacccacgtttttttcctccccgttttcacatatctgtttcttttttcagtttctcaagccgtaattgtccgttgctctcttttttataggtgatttgcaccgccgtatgttcaggcagcgactgacattcaaaccgcttagcgaaaggcaccttcacctcttgcctttctccgtcaatttcgaccgcgatcgtatcgtttccggccgcttttataaatgttccttcctgtgtaaatgacggcgccgcatcagcctccgcggtatactcgcagcctgataacagccatgcggtgaagatcagaagtatggcagacttcacacagatcacctcacgttttctcattcggctttatctttgaacagaatggccgatttgtaaagggagcctccattcctccagcgtttttccatctttggaatgaaggctatctgacctgctgtttacctgaacttagaaagaaaacaagctgatcagtctatgaaaaaggttctgtctgaaggccgaatatgcagaatttaacggaaacggacgactttctgttcattttgaaaaaatatcagatcggcaaaaaagagagccgcgtcatgcactctcccgaatagaaacattcatatttattttgagcttttcataaaatgaacgggacaacttaaaagagcagcgtattggcggcaatgatgagaataatcactccgctcagcaccgtgctgaactgtccgacgtgaaaagaaccgatgcgcaatgaagcggctttttttccaagcgagcagccgatccatatggtcagaaagcttccgaccgccgcagtaatggaaatggcagcgggagaaagcccgatcaaccccgcgcttaatccgttggtcagcgcatttgcggatacggccaccccgagaaccaaggattccaatataccgatttctcccgaaccgtcggcatccgctgcctccggattttgcagcagaccggcaaaacggcctttttttcctgacccgccaacacgcgctgtttttctcggcacagccagcagaatgatgcggataccgatgacagataaaataaacgccgccagcaatacaggaagaaagcccggtaaaacggctgaaatccatttgccgaaataaattccgatataactgaatacaaaacagataaaagcgatcatcatatttgacgcatgcgatattttgatttttctgatgccgtatgacatccccactcctaaattatcaatgcttgaggacactgccaaacctaaaatcaataaccaagccatgttcgtttctctccattctttgatgtcttttcaacatgttgtgccgttgaatctacactatcctattcagcagcacagaaaaggtaccttttctgcaaaaattattgattgacgatcatcattccggcggaaacgaggtgacacccttgacagaaaataaaaataagacactgggaccccttttaaaatcactgcttgataagcactcgctctccatgagaaaactcggcgccttaacaaacattgatacggccactatctcccggattatcaacggcaaacagaaggccaatttaaagcatcttcaggaattttcaaaacacctccgcaccccgctggaggaattgcttgaggcgtcaggcatagacatcggccatgaaaaagaagctgcgccgcaagacccgatgcacgcgattcaggatatgctgaatatggccgagatgtttgatcagcctttttcccgggagcaaattgagcgtgaactgaccagatatgaacaatacgccaaaacccagcagggccatcgcctgatttgcgatgagtttcaaaagaaaatggacaatgaagaaagcgtcggcccttttattgaccatttgaaaaacatgcatcatcagtatatggatgaatcaacaccggctgaagaccgcgcgattctcgggagcgcgctgctgtattatattttagcgaccgacgttatcccggattacatgtttccgatcggctacctggatgacgccatcgccgttcaaatcgctttgaaccggctgaaaaaaaagtaaaggcgcttaaaaaagcgccctttttgtgttgaaaaatatgaaacaccgcattacggttttgtcaaaacagagacagccgtcatatgatacatcaacctaacaaaaaggagggtgtcttctatggacagcaacacagttgtggcagtgtgcgctctgttaagtgttgtgattcagatcggaacgatattcgccgcaggaaagtggaaaaaagaataaacaaattgacggttttttcgcacaagcgtatgcttataaataaccatgtaaaagataagaaagaagatatgcatatgaaaaaaatcattctcctcttcgccgccgctgtcatattcagctcgatcggccatcaaatttcaggaggatataaagatcctgaaaaggaacggagaaaaccgtttcattcgtttaaatggttcagccggtcataacctcaggaagaagaacaagcaaaataattgcacacaatgaaaacataagctagaatacggacgagttaaactcctaaggaagaaggcgaaatgatgaagcaaacttataaaccgctgtttgaaccttttacgttcgaaagcggtgtcactataccaaaccgtatttcagtcgcaccgatgacacactattcatcaaatgatgacggaacgatttccgaccgtgaattaagctacattactccccgttcaaaagaaatgggcatggtcattacggcatgtgcaaacgtaacgccggacggcaaagcgtttccaggccagcccggcatctatgatgattctcacattcccggcttgaaaaaactcgctcaggcgatccagtctcaaggagcgaaagccgttgtgcagattcaccacggaggcttggaatgccctcctgaactcgtgccaaacaacgacgtcgtcagtccgagcggctcagaagaagacggcagacaaacgtcccgtgctctcacagaacaagaaattgagcacatcgtgaaagcattcggcgaagcgacacgcagagcgattgaagccggctttgacggtgttgaaattcacggggcaaacgggtacctgattcaccaattttattcaccgaaaacaaaccggcgcacagaccgctggggcggaagcgatgaaaagcgccttgcgttcccgcttgcagtcgttgacgctgtcaaacaggcgattgatacacacgctgaaaatccattcgttctcggctaccgcctgtcaccggaagagccggaaacaccggggcttacaatgaaagaaacattcatgctcgccgacgcgcttgcggaagagaacttggattatctgcatatttcactgatggatgtcaattccaaagcccgccgcggcgcggatacttcacggacccggatggatttattaaacgaacgcgtcggccataaagtgccgctgatggccgtcggttccatctataccgcggacgaagcgcttgccgtattagaaagcggaattccgctggtggctctgggacgtgtcattttgattaaccccgaatgggcggtgctggtcaaagaaggccgcgaacaggaaatcgaaaaagccattcaggcatctgaaattgataaataccgacttcctgaaccgttatgggaaatgattcagaatacaggcggctgggtgccgtttgaaaagtagactaaaaaactgccggatgtccggcagtttttttgattcacaagtttttaccgctttgtttactcctatttctaacacacagcgtacatatagtaaatagattaatagaaaggagaccgtatatgatggctggtttccctattacgattaacagtctttccggaaacggggttgtcaatgtcggcggtgcgttttcgataagtcctttaaccgtatcaaaaaccgtctacggctcaggagggggaaatacaggtatggtcctgcaaatgaatcaatccagcacatctcaatcttcaaactctcaatactctgatcaaaatgtaacgaaaacattatgatatccgtatttccctccctttccggctggcagcagccggattctttttgccgttttgtttaatcttattccatatcacagcgtacatatagttagtagactgtgagagaaaggagaaaaaatagaatgagcggttgcccgattacgataaacaacgtatcaggaaacggagttgtcaatgttggcggcgccatatccatcagtccgctgactgcatcaaaaaccgttttcggtgccggagggggaaatatcggcattgtcattcaaaacaatgctgtaagccagtccaaaatgtttgaacatcaattttcagatcagaatattgtaaagtcattgtaagggccgccatgctgcccttactgcataaataaagcaggcgcatgctttcccgaaaacttgattttaaacatcagcggtcaccttctcatgttttgaatgatttcagttaaagatgaatagaatgcagattgaaagcatgagtactgaatctcattaaggaaagaaggaatcgtgatgaaaaaactttgccgggaagtttggattgaagttgaccttgatgcgataaaaaagaacgtacgggcgatccgccgccatattccgaatacgtctaaaattatggccgtcgtaaaagcgaacgcttatggccacggctctgtggaagtagcgcggcaggcactggaaagcggggcgagcgagcttgctgtcgccagcgtcgaagagggaattgtgttacggagagcgggaattaaagcgcctattcttgtgctcggcttcacagctctcagctgtgtgaaaaaatctgccgtttggaacatcacattatcagcgtttcaggtcagctggatcaaaaaagcgaatcggatattggaaaaagaagcagagtcgaaacggctgtccattcatatcaatgtggataccggaatgggccggctgggtgtgcgcacagaagaagatcttttagcagtggtgaaagcgctcaagtcgagtacatacctgtcatgggatggcatctttacacatttttcaacagcggatgaaccggacactgagctgacgatgctgcagcacgaaaagtttatcagctttctccgctttttaaaaaatcaagacattacgctgcctaccgtgcatatgtgcaatacagccgccgctatcgcattcccggaattcagcgccgacatgatccgtttaggtattgggttatatggtttatatccgtccgcctcgataaaggaactgaacctcgtggatctcacacccgcactaagtttaaaggcgcgtatcgcttatgtgaaagctatggtgacagatccccggaccgtcagttatggcgccacatatatcgccgaaccgggtgaaatcatcgcgacgattccgatcggctatgctgacggttactcccgcgccctgtccaaccgcgggtttattctgcaccgcggcagacgggtgccggtggcggggagagtgacaatggatatgataatggtcagtttaggtgagaatgagggcaaacaaggagaagaagtcgtcatctacggcaaacaacaaggagccgagatttccgttgatgaaattgccgaaatgctcggtacgatcagctacgaagtcctttctgtgttaagccgccgcatcccccgcttttatttcagagacggcaaaatcattaaaatatcagctccggtattatacgtatagacggcagttcccgtatttatgtatagaacaagtaccggcgtgagtggttcccattgttttcgtcagcaaaatctcaaaacgccttctcttccgcgttcatgcacggaatagaaggcgcaaaaagacatttagccaaaggcttgcgttacgaagctttatgctccaatctcagcttgtcagcaaccatcgcgatgaactctgagttggttggttttgcttttgtcatgcttaccgtatatccgaacagtgaagaaatggaatcaatatttcccctgctccatgcgacttcaatggcgtggcggatggcccgttctacacggcttgcggtcgtgttgaattttttggcgatgtcgggataaaggacttttgtgatgctgccgaggagttcaatatcgttatacaccatggaaatggcttcacgcaaataaagatagcctttgatatgggcaggcacaccgatctcatggataatgcttgtaatgctggcatcgagatttttccgcttcggctccggctggctgcggataatgctgctttgcgcagacggcgcacggtgtgtgacactgctgacatttccgcttacctggcggatatggccgacaaggttttccatatcaaacggcttcaggatgaaataggatgcgcctaaatcgacggcttttttcgtaacgtcttcctgaccgaatgccgtcagcatgatgacgttcggctgcttctcaagctctgattcacgcagacgctccaaaaccgcaagtccgtccagatgcggcatgataatgtctaacacgagcacatcgggattcttatctttaaacaaagaaagacattcctgtccgttataagcaacgccgatcacttccatatcatcctgtccctctatatattcactcaacaggcttacaagctctcgattatcatcagcaacacaaactttaattttctccacgtttcttcctccccaatgtattaacaggacgcaacccatttgactgctatatgttacattcgacaaaaccactacttccccttttaaaaaatccatatttaccaataatagtggtatatctttgtttttctagcattttctaggtttttcgactaaaaattaagtttgacaaatcaggaaacgtgaatttgtcgaaaaatcttcatgtcttattttacatgaatcccggaaagaagtgaagaacgcatcacataaaaaaactgccggatcatccggcagtcagcttgctttgtctttcccgtaaacatcaacacccgcttcagacagcatccattcgatatgaacgccatagccgcttgtcggatcattgacaaatacgtgggttacggctccgacgacctttccgttctggatgatcgggcttccgctcatcccctgaacgattccgccggttcttttcagcagtttcggatctgtcactttcaataccattccctttgtcgccgggaatttttgcggcgtggtgctgacgatttcaatatcaaatttctctactttatcgttttcgataaccgtcagcatttgcgcaggtcctttttttacttcatttgacaaagcaatcggaagcgctttgtcggaaatgttgtttttaatcggctgatgcagtgtcccaaaaatgccgaacgggctgttgcggttaatatcgccgatcgttttccgttctgacgaaaaccttgccagtttttcgcctggattgccgccttttcctttttcaatcgatgttacagtagaacggacgatttctccgtcttctacaacaatcggtttttttgtatccatatcagagatgacgtggcccaatgcgccgtatttttttgttttcggttcaaaaaatgtcatggtgccgatgccggctgccgaatcacggatataaaggccgattcgatatttcccctcggcttcgtcctttgtcggaatcagctttgttttgattttttgcttatcgcgtttcaccaataaatccagagattcaccggttttgcccgctttttgaataaacggggcgatgtcgctcattttttcaattttatgtccgttcattttaataatgatgtcgccagattcaatacccgcttgttctcccggagactttttcccatcctttgtcatcacctggtgaaaaccgacgaccaaaacaccgactgaatgcagttttacaccgatggactgtccgcccggaatgaccttcaattcaggaaggacacgcactttcgtttttttaatgggaaatccggcaagatcatatactacttctgacctgccttgtgtttgccctgttatgtttgcatgaccgtgctcttctttcagcgtaaaggcttctgataattcgcccttttcagcgcttattgatgcattgaccggaacggcctgtgtctggttttcaaagacgctcatttctgacggtatcagtaaatattctttaaacggcttaaaaaagcctacacttagtaaagaaacaaggagaattacacctattgctttcctcatgttatcgtgcattcattccttcactctcctcgctcctatcccacaccactttctttttctgctacatctatacttttgccttcctgcgcttgatttataaccggcatacgaagaaaaacattggatacactgttagagaaatggaacaaaaaataagctgcctgtatcagcagcttatcctgtcgtttttacctgtccggcctgttttaaaagctcttgtgcatgccgttttgtcagatcggtcacttcaacacccgcaatcatgcggccgatttccgctaccttatcctgcttggaaagcggcgtgacatgcgttgtcgtccgtccgtctttgaattcttttgcgatcagaaggtgcgtatccgccatagcggcaacctgcggcaggtgtgtaatgcagagcacctgtgaaccggtcgatactttatggattttttccgcgatggcttgggcaacccgcccgcttacaccggtgtccacttcgtcaaagatgatggaggtgacatcctgctgggaagaaaaaatactcttcatcgccagcatcacccttgaaagctcgcctccggaagcgacctttgacagcggttttaaaggctcaccggtgtttgttgaaattaaaaacttcacaaggtcgatccccttttgggtaagctgcacgggctgcccgttaacaaccggtgcttcactggctgacggatcggttttcacgagaaattccgtatcaaacgttgatttgcccatatacagactttgtaattcctgatgaatcgcttccgccagtttcttggcccatgcttttctgatttttgataaattggcggcttctacggccacatctttgccgaccgactccaattccttcttcagggcttcaaggtggctgtcgcggttctcgatttgatcgatttcctcttctattttagagccgtattccaaaatgtcttctaccgtcgctccgtatttgcgcttcagctgtttgatctcatttaaacgggtttcaataaaattcagccgttccgggtcatattccagatcatctaacagattgcgcatttgaaaggttgcatcctccagcagataataggaacttgacacactttcagacagcttttgcagcggttcattgatatccgaaatatcttcaagctgggcagaggccattccgacccagtcaagcccccctgctcgctgcggagcgcattataggcgttttgcaatgattcataaattttttcaaagttggatatctgcttccgctcttcctgaagaagttcgtcttcattcaattcaagcttcgccgactcgatttcttcaagctgaaattgaatcaggtctaaccgatgcgccatttcctgctcgctttctgacagcttcttcacttttttgagcagctccatataacgctcatagccttcatggtaagcctgaagcgcggattcggcctcagcgcccgcaaatttatccaaaagctccaagtgtttgtcgtcctccattaacagctggttatcatgctgtccgtgaatatctaataaaagtctgccgatttcccttaaagccgcaatcgtcactaattttccgttgacacggcagacgctttttcctccggcattgatgtcccttctcatgacaatcatgtcgtcagatgcgtctattccctgctcacggcatacttcaaaaacgggatgaccgctgtccaatagaaacagtccttcaagctcggcctttgtttcaccgtaacggacaaattcggacgagccgcgtccgccgactaatagggaaacggcgtctataataattgacttgccggcccctgtttctcccgtcaggacggtgagcccccgttcaaacgaaatcgtcagttcctctataatggcaaagttttttattgatagttcagctaacaaacagcattccaccttttatctgataattacgctacagcagctccaaaagacggctttgtacgccttccgtatcttcaggcgtcctgcagatgattaagatcgtgtcatctccgcagatcgtgcccatgatttcttcccattcgagattatccatcagagcgccgattgcctgagcattccccggcatcgtttttaatacgatcatatggcttgctgagtcaatttttacgaacgcatccattaatgaacgcttcagttttgacagcggattgaaccgctgatccgccggcaggctgtatttgtaggagccgttgttcgtcggcacctttacgagatgcagctctttaatgtctctggagacagtcgcctgggttaccttatatccttcttctctcagcatgtcaactaagtcatcctgcgtttcaatctcatggcttgtaataagctctctgatttttatatgcctttggccttttgtcatgtaagcacctctgttttcaagctgttcttgtcattatgttaaccgcttcttgataaaaagtacatgatggcagaaaaaaggaataatagccccctattattccggtacatctgtctttttggcttttaatgtctcatgtgcttcgcggacgatacggagaatatcttcttccggcagttcagcgccgtttccgtcttctccgcccattccagatgaagcagaaactcaatattgccgtctccccctgtaatcggtgagaaggacagtcctttcactgtatatccttcagaagcggcaaattgattcatgcggcggagaacgtcagcatgaacgccgggatctctgacaatgcctttttttccgacggattcccgtccggcttcaaattgcggcttcaccagtgcgatacaatcgctccccggtacaagcagcgtttttaaaaccggcagaatgaggcggagtgagatgaaagaaacatcgattgtcgcaaattccggcaaaccctctgtgaaatcggaaggctcggaatagcggaaattcgtccgttccatgacgacgaccctctcgtcctgtctgagcttccaagcaagctgattatagccgacatccactgcgtaggaccgctcagctccgttttggagggcgcaatccgtgaatccccctgtagacgagccgatgtcaatcatcgttttgccttttaccgagacaggaaacacttccaaggctttttcaagttttaatccgcctctgctgacgtatttaagagggtttccttttaccgttaacggaagatcccgggcgattttttcacccggtttgtccaatcggttttcatttgagtatacgatgcccgccataatggcgcgtttcgctttttcccgcgtttccgcaaggcctttttctacaagaagtacatctaatcgttctttttttgctgtcatgatccaattcctttatgtgtcttcggcggcatcagcagttttatccgattcataacctcagccttcgtgagaccgatttcttcaagcagggcggttacgctgccgtgttcaataaaccggtctgggatgcccattctgtcaatcggtgtatgatacatgccgaggtcatgagcgtattcaagaatcgtgctgccgaatccgccttcaagcacagcttcttctatcgttaaaatcggcagaccttcattaagaatggccttcatcatttgtttatcaatcggctttatgaacctcgcattcacgacacgcacggacaggccttctttttgcagttcttcagccgcttccagcgccatttcaatggtcgtaccgaatgttaaaatgaccgcgtcttttccgggacggagcacttcccatgttccgatcggaatggttttcagctctttatccatcttaacgccgagcccgtttccgcgcgggaagcgcatcgcaatcggaccttcctcgtatgaaagggctgtattgaccatatggcggccttcattttcatccttcggcatcattaaaacgaggttcggtatatgccgcaaaaaggcgatgtcaaagacgccttgatgcgtctccccgtcagcgccgaccaaaccggcgcggtcaatgccgataaatacattcgcgttttgacggcagatatcatggacgacctgatcgtacgcccgctgtaaaaaggtcgaataaatcgcaagaaacggcttcataccctgaagcgccattcccgcggccattgtcgccgcatgctgttctgcgattccgacgtcaaacatgcgctcaggaaattctttcgcaaatccttcaagcttagagccgaccggcatagccggtgtaatcgcgacaattctgtcatcctcgcgcgccagctcctgcacggtgccgctgacaagtccgctccatgaaggcgccgcggctttcggcttgacgaaatcacccgtattgattttataaggccccgttccgtgccatgtgccgattgtgtcggtctcagccggtttatagcctttgccctttttcgtaatgacatgcaaaaggacaggacctttcgtttttttggcgtattgcaggttttcaaacagttcgtggtaggaatgaccgtcaacagggcctaaatacgtaaagcccagctcttcaaaaaacatgcctgacacaagcatatattttaagctgtcttttatccgttccgctgtggcggccaattttccgccgacggccgggatgcgcttaaataaatattcaagctcgtcttttacccattgatatttgccggccgtgcgaagccgtcccagcatagaatgaattgccccgacattcggcgcaatgctcatctcattatcattcaggatgacgatcatatcttttttctcatcaccgatatggttcagcgcttcgagcgccattcctccggttaaagcgccgtctccgataatcgggatgatatattctttcgatcctttaatatcacgggcggctgccattcccatcgcgcctgagagcgatgttgagctgtggcctgtttcccatacgtcatgttcgctttcgctgcgcttcgggaaaccgcaaagccctttatattggcgcaaggtttcaaactccttgccgcgcccggttaacagtttatgaacataggactgatgtccgacatcccataaaaatttatctttcggactgtcaaattctttgtgaagcgcaattgtcagctcgacaaccccgaggttcggcccgatatggccgccagaggcagacagcgatgtgatgaggaaattgcggatttcctcactcagctcttccagctgttcaattgacatctttttaagaaatgacgggtcctgtattgataaaagatccaaagcggatcaactcactttcagcatgaatttctgcaaattaaacagtgtctttttgaaaaaagaaaaagactccctttgtattttcatcgaaactgcttacattttaccataggagcggcagccccttcaaatcaggaccgtttttaatgatctctcgccgcgattaaatcacagaggtcatgcagcagttctttctgaagagaaaggccgctgatgatccgtttcgcctcgctgatatgatacgccagcttctctttcgcgccttcaagcgttaaaagcgacggatacgttgacttttcattcgacgtgtctgagccgaccggtttgccgatcttctcctcatgcccttcaatatcaaggatgtcatctctgatttgaaatccgatgccgatatggctgctgaacagacgcagcttttcgacttcatcctccggcgcatctgccaaaatggcgcccgccgtcacagaaaaaccgaggagcttggccgttttccgctcgtggatggattccagctcctcaagcgttatccgcttttgttccgcttccatgtcggcagcctgcccgccgaccattccttccgttcctgccgcgctgatcagctcatcgacgagacggagccgtttttctgctgaaaccgcctcagacacgtgggatgtgatcaatttaaagctttctgtcagaagcccgtctccggccaatacggctgccgcttctccgaagactttatggtttgtgggctttccccggcgcagatcatcatcgtccatgcaaggaagatcatcatggattaaggaatacgtatgaatcatttcgacagcgcatccgaccggaatcccgtctttttcatcttttccgtaagcattcagaacggctaagacgacgagggggcgcagcctctttccgcccgcttccaaagaatacagcatagattttttgaggatttcaggcatcgcaagccgttccgtatacaaagaaagctgctgttcaatcagttttttgcgcgatgctaaaaatgcgtccagtttatttgtcaccttcgtcttcctcctgaacgctgaaaggtgcaagttcgccgttatcttttaaaataaagtccatttgcttttcgacatgctgaagcttttcatggcacatttttgaaagggccatcccttcctgaaaataattaatcgcctgctcaagcggcacgtctccttcttcaagctttgccacaatgccttcaaggcctttcatcgcctcttcaaatgtcagctcttcactttttttggtttctgtcattttcgttcgcctctcttttgcaatacttcacacgtcagaacgccgtctgtcatctttacttcaagcgtatcattttgttccacttgatcaacgcttttgatcagctctttatctttataggccagactgtatcctctctccatcacctgaaggggacttaatgcattcagtttaccaagaaccgtctgaaactgcgaatgaagctgcttcagctggacattcatgcttcgggcgagctgatttgagcgctcctcgtaccgttttttcgcctgtttcagctgggtttcagggtggagcgccgttaatctgtacgtattccgctccagctgcctttgtttcctgtccgtaagccctgtgagctgtgattggaactgctgatacaaaagatcaaactgctgttccttttgggtatacaatcgtttcggaaaacggaacgcgtaggatgactggagcgatagaacccgttcttttttcttgctgatatgctgctgcatcgctcttgtcagccggacttccgccgtttttgtccgttccattaagtccgtcgtatgggggacggcaatttctgccgctcctgtcggcgttgccgcccggatatccgcgacgaaatcactgattgtaaaatccgtttcatgtccgacggctgatataatcggaatggcggaagcaaaaatcgcccgggctacgctttcttcgttaaatgcccacaattcttcgatcgagccccctccccttccgacgatcaggacgtcacacattttttgtgcattggcttcttcaatgcgcttcacaatcgatctgctggcattttcaccttgaaccagcgcgggaagcacaatgactttcacaagggggtatcttcttttgagtgtggtaatgacgtctctgacggctgctcccgtcggtgacgtgacgaccccgatcgtagccggaaaagcggggatggcctgcttatgccggtcatcaaacaacccttcgccggcaagttttttctttaattcttcatatgctaagtagagcgcccccacaccgtccggctgcatttctttcgcgtacagctgatagcttccgctcggttcatagacggaaatgccgcctcttacgatgaccttcattccgtcctcgggcttaaacgcaagcctcgaactttgtctttgaaacatgacggcctgcatgcgggcatgctcatcttttaatgtaaaatagatgtggcctctcgtatgaattttaacattggagagctcacccttaatccaaatgtcttcaagatgagggtccacatcgaattttcgtttaatgtatttggtcagcgcggaaaccgtgacatatgccgcttcactcacatcctgcactcctttcataaaggctttttgccctaaactaagaaaacccgctctggctgaaaggagccttaagaagcgggtatcgtgctcattgtcacactttttgtgactgtctccggttatctatgataacgtacgtctggcagatttaacagtattatgcgcaagcattgtgatggtcatcggacctactccgcccggcaccggcgtaatgaaagatgctttttctttcgcttcatcaaactgaacgtctccgcagagttttccgctttcgagacggttgacgccgacatcaatgacaatggcgccctctttgatttgatcggctttgatgaaattcgctttaccgaccgctaccacaagaatatctgcttttttcgtatgctcagacatatttttcgtacgggaatggcaatatgtgacggtcgcgttttcgttcagcagcagctggccgaccggtttaccgacaatattgcttcgtccgactacaacaacttctttgccggaaagatctacgttcgtctttttcaataactcgacaattccgtgcggcgtgcatggtagaaatgtatcttcgccaagcagcattttcccgacgttgagagggtggaaaccgtcaacatccttatcgggagagatccgctcgattacggctttttcagaaatatgatccggaagcggcagctggacgagaatgccgtggaattccggattttgattatactgatcaatcactgttaaaagctccgcctcggttaagcttgagtcaaagcggtcaagtttaaatttcattcccattgtttcagcggcttttttcttgcctgtcacatatgaaacagaagcgggatcgtctccgattaaaatgaccgccaaaccgggcactacgccttgtgctttcagctcttctacttcttttgccaattgttcgcgtttttctttagccgtttcttttccgtcgatgattgttgcagtcattttctttcctcctatgattcgatatcagttttaatgttagaaagaaccccgtttacgaattttgcagctttatcgtcgccgaaccgttttgccagctcgattgcttcgtttaatgacacgttagcaggaatgtcgtcagtataaaccatttcatacaccgccagacgcaggatcgcgcggtctacgtttgcaatccggtcaagcttccaattgacgagatggccggaaatcatttcatcaagctgaacctgatgttcgatcactccgtacaccagctgttcaaagaaggcatctgttttttcaccatcaagcgcgtgctcaatggcctcgttcggtgcaatatcgctgacatcaatctgaaaaagtgcctgcaaagctttttctctagctgttcttcttttcattttctttctccttcagatccgctttatccgcttgtcgttaagcttaaagagatcataacatatttttttctcaatcgcatgtcgaaatttaggttttttcaccctaatgccgaatattttcacaaaccgtattaatttcattcggatttcacagcatgaagaaactcggctgccgtttgtaagccggctttcttcatgcctgaaatgacgggaaacgtataaaaaaccaaagggctgcccatccccttggtttttatacgctcattacatttcttcgtcgatttcgacttcttgggctttcgtgtcaaattgaatgccgacgatatgaatattgatttcattaatggtcagagacgtcatgtttaataaggtttggcggatattctcctgaacgcttgccgccactttcgggatcgagatcccgaattgaacgacgcaatagacgtcgatggtaatcccgtcatcggctaaatcgacctttacgcctttaccgtgattgattttgccgaagcgttctacgacgccggtggcgaaattgccgcgcatttcagcaactccttcaacttcggaagcggcgatgccggcaatgacttcaatgacctcaggagcaatttcaaccttgcctaaatgagcctcgtcatgatccattttaagcacactgttgtcttccattcaattcacctcccgcaaaaattatgagcccattacatcatatgtttctaaaaactttgtattaaactctccgctgacaaatgtttcgtgttcaagcagtttcagatggaacggaatcgtcgtttcaataccttcaatcacgaattcgctcagcgcgcgtttcatccgtgcgactgcctcatcacgcgttgttccgtatgtgatgactttagcaatcatactgtcatagtacggcgggatcgaatagccgggatatgcggctgaatccacgcgtacgccgagtccgcccggcggcaggtacatgttaattttaccgggtgaaggcatgaagtttttcgcaggattttcagcattgatgcggcattcaatcgcccagccgttaaattcaacgtcttcctgtctgagcgaaagctcctgtccggatgccactttgatctgttctttgatcagatccgttcccgtcaccatttctgtgacagggtgctctacttgaatacgcgtgttcatttccatgaagtagtagcgctgttctctgtagtcataaatgaattctactgtgccggctcccgtgtaaccgacggccttcgctgcttttaccgcagcttcgcccatctgctccctgatttcagaatcaagcgcaggtgacggtgactcttcaagaagtttttgcagacgtctttggatagaacagtcacgctctccgagatggatcgtgtttccgtaattatccgcaagcacctgaatttcaacatggcggaaatcttctatgtacttctcgatgtacacacccggatttccgaatgccgtagcggcttcctgctgggtaatctcaatgcctttgatcagttcttcttctgtgcgtgcgacccggatgccttttccgcctccgcccgcagtggcttttataatcacaggatacccaatttcacctgcaagcgaaaccgcttcttcggtattttttatgattccttttgaaccgggcacaatcggcacaccagccagctgcatcgtgtcgcgcgcgatatcttttgttcccatttttgaaatggcgtcagccgtagggccgacaaacgttacgttcaattcctcgcacagctcggcaaagtcggcgttttcagctaaaaacccgtatcccggatgaatcgcatccgtgccggtcagctttgcgacgctgacgatgttcgttacatttaaatagctttcttttgatgttttcggcccgatacaaaaagcctcatcggccatttggacatgcagggcgtctttatctgcctcagaataaacggctacagtttcaatgcccagctctttgcaggcccggatgattctgacggcgatttctcctcggttggcgatcaatagctttttaatcataatagcaggtctccttactcagcttttacaagaaatagaggttgtccgtattcgaccagctggccgttttcaactaacacttcaacgatttctccttttacttcggcttcaatctcgttaaagagtttcattgcttctacgatacaaacaactgtattttcgctcacttttgaaccttggtttacgtaagggccggcttccggcgatgaagaagcataaaacgttccgaccatcggagacgtaattttgtgcaggttttcgtcttgtttcggcgcttcctgaacaggagcggcttcatgcgcttccggttttgcagcctgcggagcaggtgcgtaagcggcgggaacggcttgagcttgtcccgttacattcactgccggcgcttcattttttttcagtttgaggcttacgccttcgatttcgtaaacgaattcgtcgatggaagattcatcgattctttttatcagttcatgaatttcgttgatttttaacatcagtttccactcctatgtataaaaaatagaaatttatgggttgctactaaaagtacatactatgtttatcttacaggagcgcttgtgtaaattcaacactgatctaaaatgacatcagaaaagcccgcagcgggtgcgggcggtggagatctcttattttgtcggttcaaacgtgacggcgacgtctttcatcgtcttgatttctttttccaccaggtcaatgatagcggaagcttttgcgtttgaatgtttgtcagacatgaccgtaatgttgattttgtctccttcagcatccacgagcgcatctttgtagccttgtgttttaatcagcgtttccagctgtttttccgtcccttcagcattgctcagcgccgtcattttatcgtaggcttcgcttttttcctttgcggtcgcatcatcgcttgaaacaatgctgtttaactgttccctttctttgcttcttgcgtcttcaagttccatgcggtatgcggtaaataagttttcatcagctgtttctgtagcgaccgatccgtctttgtccgatgcttcggctgatgtttctttatcctcttttgcgcctttagaatctttcgttccttttgttccgtcttctttatccgtgccgcttccgttcttatctttcgtttcaggagccggcgttttttcagttgccacttctccgctgcttttttcgcttttcatctgcacggcatttttgctttccggcgacataatataataaacacttaataccacgacgagactgagcattgttaaaagccaaaccgtttgttttttcagcatgatttatgaatcctccttgatttttttaggggcaaccgctacacggtagctcggaacatcaagcacccttgtgacggcatcaatgatggttttttttatttgaacgttgtccactccctgagcgacaacgagtacaccgcggatatcgggctttttcgtctggacgacgaccggggtttcctgatccccgtttcgaatcatgacaatttgttcttcagaggtttgatcggttacgcttcttttgccgccttctttatcggtttcttcggtggtggtgtcttttttcgttttatttttctcaaacactttcaaagatgttgcgtctacgttcacgacaattgatacatcctccacgccgataatcgtttcaaggatttctttcagctggttttcatagtctctttcataatcatcgatcgtgtttttggcgctgctgtctttcgatgccttaaaaacgggtgcgcttttttgcccgcttttgtcttccgttcggccggacatgacggtctgcgccgcttggtccttcccggttttctccggtgaagagaacagctggctcaccagcataaaagatactccgagcacaaacacgaacagaaagtaatgatattttgtcagttttggtttttctccgtctttcgcctgtccgatcatcagctgttttttgagtatggtccatagtccgtttttattcatggccgtttttctccccgccttccatataaaccgtaattttctcactgccgatttcccatatatccgcaagtttttctttgatgtctgcggcctcttttttttcggctgcgccttccggttcgtatttgcggtctgtgcggatgtcgatcggtgcgacggtttgcacggttttttcagaagatggggccatatacacgctgatcgtttttacatcttcttctgaacgaacctgttcttccgctgtaaggcggatgtcgtctattttgtattcgtcatgactgaacatctcctccgctttcttttttagttggacagccatttcttctaaaacatatgcgcggtttgatgcttgtatttcttttttttctgatttgatttgattttttatatcagcggattgagattgctcttgttttgtcaaataatcgaagatgatttccgggtctgttttgaaaagtttgaagatcgggttgagcatgacaatgattaacagcaggctgacaaccatcttggcgtatttttgcatactggagctgggcagcagcatgtcgatgacgatggcgaataagataaacaaaataatgcttgtcagccattctgttaaaaagctcatatccaatgggcctcctttatttcatcatcatggtgaggttgcctgctgtaataatgactgtaatactgaggaaaaacatgagagagacgatggcgagcgccgcgaaaatatacagcacgcttcggctgatgacgccgaggcacgtaatgacgggcccgcctccgagcggctgcagaatagcggccgcgagcttataaataaaagcgagcgagagcactttgatcgccggaaacgcggagatgcagatcaaaattccgactcctaggattcccacggtgttttttaataggagcgatgcgctgatgaccgtatccgtcgcatccgtaaacatccggccgagcacgggaataaaattgcctgtgataaattttgcagtcctgagcgtaatcccgtccgtcacggcagccgaagccccctgtacggagatgacgccgagaaacacggtgagaaatacggcaagcgcgccgatcgcgatatttctgagcagattggcaagctgcgtgactttatattgatccgtcatcgtgctgacgatgcttaaaatcgctgacaggaaaataagcggcatgacaatgttttgaatgagaaggccgctcgtattcatcagaaataaaataacggggtgaaaaaaagctgcggagacggctcccccggaagacgccaaaagcgcgagtaaaagcgggatgagcgcgagaatgaaacttgtcatcgtctggatcgcttcactggcataattgacggcaacatgaaagctgtttaaagcgagaataatcagcaccatgtagacgattgcataagccactttgctgacagtgctctgctgaaacgcattttgcaaaagctgcagaatgacacaaaaaatggtgagaagaatcaaagttcccagaagctttccgtttgcgagcacttcatgaaacaagtatgaaaataaagccttcagccatgcctccggcgagaacgttttttcaccgttaataaagtcgatgatgcttcccttttggctttcaggcagaagaccgccgtattctgtcatgatgtcgtcccaaaactttccgatgccttctgttttcagcgcttcggcctgctttttcgccacttcatcagcggattcttggtgaactgcggtttcctgcgacgcaccgtctgttccggcagcttgtacacattcagtctgaaaaaataagaggatgaacaaaaaagcccccgcccaccgaaagcgcttcattttttgtgcccccctttccattttattgatgatcaagaaggaataagtccgagaatcgtttcaataatgacggtgagtatcggcacggccattaccagtatcaaaatttttccggccagctctattttcgaagcaatcgctccctggcccgcatcctttgtcagctgcgcaccgaattcagcgatgtaggcgatgccgataatttttaaaatggtttccacatagaccatattgacatttgcattgacggctattttttctatcattctgataatgtcgtaaatctgatcgatgagatagagaaagatcacgcagccgctgaagacgacaatcataaacgcgaaagtcggtttctgttcttttacgatcagggagagaaatgtggcgatcaggcctaaacctacaatttgaacaatctcaatctgtaagcccccctatccttggaatagaaacacagctttgatctttttgaacaggtcatcgacaatcgtcgccaccataaataaaatatagataaagccaagcagcgtcacccattgggcgtattctttttttcccatttggtcaagtatggtgtgcagaaacgcaaccacgataccgactccggcgatttgaaaaatgacatttacgtcgactcccattttatgtttgctcccctcatgtttacatcaatagaagaatgagtaacagtccggctaaaaatcctaagcttttcaccattttttcatttttcgcctgcgcccgtccggcatccgcttccgccgcttccaaatgtgtaagcgcaagcttgatatgtttctgctgagaaacacggtcatggagcccgagcgtctctccgaattgcttcagcacatcgtattcgctttttttcatcgccatggagggccagttatgtttcaagctctgttcccaggccgttttggcggaatcgcttccctgctcaagcctcctgctgaaagcttgaaacaatgacgatacaggcttggaaagctgtgcggcgatttgtcccgaagctatgtgcagcggcgtatgcccgaacatgatttccgcttcaagcgattgcagcgccgcgcgcagctgacggatctgtctcggcctttcaatatacattttggcgatctcaaatcccgtccatgtcgtcgctgtcagaatgaacacggcacccaaaagcttcagcatgtcatcacgctttcagcatgcggaacaggtttcccgtcctttccgtacatcctgctgatcgttcccggaccgcggcgtcttgacagttcaacataccggtcaaacacgttttcctcccaaagcattttcagcgacggcctcttgaccaagtctttcatattccatccgtgcgcagagacgataacggatacgcccgcatggagcgcctccagcagcgcttgtgagtcttccattctcccgatttcatccacaattatgacatcaggactcatagaacggatcatcatcatcagcccttccgccttcggacaggcatcaaggacatcgactctgcggccgaaactgtgctggggaatgccccgcaggcagccggcaatttccgaccgttcatctacgatacctgtcttttttgccggaatgcgttttgatccggtgctggaaagccgggccaaatcacgaagcaaggtcgttttccccgtttgcggaggaccgatgatcagcgtgttcagccagttttctttccataagaaaggaatgagcggttctgcgatccccagcttctcccgggcgattcggatattaaaagaagtaatatcccggagtcctttgacggctccgttttcgacgatgactcttccggccagccccacacggtggcctcctctgattgtgatgtatccttttttcagctcttcttccagcgtgtacatactatagttgctgagccggctgaggatcagctgtgcgtcgccggccgtacacacatatgacaaatacaaaggttgtcctttttggatcagttcaaccggcctgtcgacccggattctgatttcttctgtatcccgcctcgcttcttcgggcacggcggagatggcatctctcaataattcagggagaacctctgtaatttcattcaatagagtcccctcctttttaccgattggcttctttaaaatgtatgatccgggacagactttatgacaccccggccctctatttatgcacaccggccaaaatcagcaccacacccgcaaaaatcaatattaattttgcatatgagagctgtccggcaatctgataaatgccgatcgtcattgtgatgataaagatcagagggccgacgattgccaaaatactattcaccacaaccgcttttctgatgtcgtttgtcaaaagcatgataatagcggcagataattcaatgagcgaggacaaaactcgtaaaccggccatcgttaaaacagtagaattgattgaaccgaacaaaaatttcattgcaatcccccaacttcaagcattttgttacactatatgctctagctcacggaagtagtctcactattttcatatagaagaaagattctgaggcagaacgcaaaaaaaagcctgccccgtaaaaggagcagactccgaatttctttaactacgctcttgacacgtaagaaccgtctgatgtatttacaaccagcgtatcgccttcgttcacgaagaacggtacgtttacgacaaggcctgtttccgttttggcaggtttcgtgccgcctgacgccgtgtcgcctttaattcccggctctgtttcaacaactttcagttcaactgtgttcggcagttcaataccgagcgtttcagactgatacatcatgatatgcacagacatattttccagaaggtatttcaattcttcttcgatttggttttcgttcaattcaagctgttcatatgagcttgtatccatgaacacgtgctgatcgccgttggcataaagatactgcatcgtttttgtttcgatttgagctttcgcgactttttcacctgcacggaatgttttctcctgaatagcgcccgtgcgcaggttacgcaatttagaacggacaaatgccgctccttttcccggttttacgtgctgaaagtcaacgacgcgccaaatgccgccgtctacttcaatcgttagtcctgtacgaaaatcgttaactgaaatcatgtttgatgtcctcctatactccgatcacaaaataattaattctttaggggaatgcgtaattgtccggttgccgtcctcagtgatgatgatatcatcttcgattcttgcgcccccgacttccggtatgtatatgcccggctcaaccgttaccgccatgcccggctcaagaacggccgatgacctgaaagacagccccggtgattcatggacttccattccgaacccgtgtcctgtcgaatggccgaaatactgtccgtagccttttgcggtgatatgatccctcgtcagggcatccgcttcttttcccgtcatgccgggtttaatatgcaggacaccaagcgcttgggcatcgtatacgacctgataaatctctttcagtttatcacttggctctccgaccgcgacggtgcgtgtgatatcagaacaatagcctttataataagcgccgaaatcgagcgtgaccaagtctcccttttcaatcaatttgccgcttgccactccgtggggaaggctggatctgactcccgaggcgacgatcatatcaaaggaagagccgtctgctccttgacgtctcatataaaattcaagctcgtttgcaactgaaatctctgagatgcccggtttgataaacgtcagaatatgttcaaacgcatcatccgcaatcttcgcagcttcctctaatatcttaatctcttcacttgacttaatcaagcgcaacttttcaacggaatccgcgacgggaaccatctccgcttcctgcagcaccgcttggtaggatgcatatgttccgtacgtcatgctgttttgctcgaagccgagttttttaatgccgtactcaagaatcgtatccgcagccgtttggattaagcttccgccgtgctcgataatgtcaaaacccttcacttgcgtcttcgcctgctcggtgtaacggaaatccgtgataaatgccgcacgttctttcgatatgaccgcaaggcctgacgaacccgtaaatcccgtcatgtactgcagattggcggagcttgtcaccaacattccgtctatatccagctgaccgaaaagatttcgcaatttctcaagtttcattccctttctcctcctcgccgattcttgactgccgcctgacaacgcgggagcatccctgcccggttttcagcataaaaaatgttcacttctcgtgaacattttaccataccggacagggattatacacttattcacttgttgccgagcgcccttgcaagcttgtctgacgtaagttcattgtagttgaaggaaattgagtagccgacaaacaaaccgtacagaatgtaaaggcaaagcgtcgtcacgattgtatctgatttcaattcagtgacggatttcacatcttcgaaaatcggattgaataagaaaaaaaccgcacaccataaaatgacgccgtacaccatccccggccacatggttttaaaacgcttcaggcagacgaaataaataaacgccccggcaattgaaatgaatccgatgacaacgatgctgaccatcgtgcccagccattgttttttccattctccgatcataaacggctgaagaatcatgttggggctgatctctgaaaaatgaaagacatacccgagatagccgatcaaactccaaaatacaccgccggcaaatccgataccgcaaattctgccggtaaatgaaacaggctgctgatcatcatcctgcttctttttttcttcctgttctgaatgtttttcgcttgtcatcatggcacctccagtcatagactgcccaaaaattgaaaagtcataaaaagctgcgccatattttcattcaatgagtaaaatctaaagaaacggggtatactgcatgtagaaaaagcattgattttccggctgtctaactagaggtttaccgcggtttcctgtacaatagagtgaaaggaaatggttagtaaatcctaagaaaacaggcaggttgataaacaatgtccaaacaaaaaacgccccctgcatacggcgggcaggctgtcgttgaaggggtaatgttcggcggcagaaaaaattatgttaccgccatccgcaggaatgacggaagcattgattttttcaagcttccgagagtgccgaacgccaagctttcggctttaaaaaagattccttttttgcggggaattgtcgccatcattgaggcgagcgccaacggcacaaagcatttaaacttttccagcgaacgttacgggcttgatcctcaggatgacgccaagctggagcaggaagagaagaagggttccggcttatcgatgtttttcagcctggcggtgatcggcgttctgtcgtttttgttcagcaaattcgtttttacgctcgtcccggtcttcttagcggagcttgtaaggcccgtattttcctcagacgccgcgcagatcggaatcgaaagtctgtttaagctgattctgcttctcggctacatttattttttatcaatgacgccgttaattaaaagagtgtttcaatatcatggagccgaacataaggtcataaactgttatgaacagaatttgccaattacaatagaaaatgttcagaaacagtcacggcttcattaccgttgcggttcaagctttattttatttacgatcattgtcggcatgttcgtctatttactcgttccgacagatccgctttgggtgcggattttagacaggattgcgcttataccggtcgttctcggcatctcctttgaagtgctccagctgacgaacagagtacggaatatccccgttttgaaagtgctcggttatcccggcctgtggctgcagcttttaacgacaaaggaaccggcggatgaccaggtcgaggttgccat

SEQ ID NO: 4 - DNA, 1090715 bp, Bacillus amyloliquefaciens
agaaagctttaacgagcttctcagactggaagacatttcagaacagagcgaaaatccgtctcacaacgtaatctgaaccgttaccgttattattttggaggtgggcagttatgaatcatcgtgtacaacctttttttgctgtattgatagcgcttggcgcattcggtttcatttatgcggcggtaaccaaccccgggcagatgatttcaagagcaatcaccgttattatcgcaggcattattatttattttatcgtgaggacggtcctgaaccgacgcaccggccgtgacggaaccgctttcaaaaaagcggccagacaatcgcggctccgaatgaaggagcaaaaagcgaagcaccgcgccggacacagaggccgggtcagccatttgcggagcgtgccgagcagcagcagaccgaagccgatgattcttaagaaaaaaagccagacccagcttaccgtcatagaaggcaaaaagaataaaaagaaaaacagagcgcttttttaatagctccattgcttcaaaaattgctctgttctgctttttcctagctcaatgagagctagttttttttgcggtgtgagatgaaactccgtcgccatcacatgttccaccggaataaaaataatattctgttcgtactttgtcgcgatatgcctggcatcatgagcgtctttcatcgtttcaaacaaagccccgaacagctcaaaagcgttgcggattgattttttcgggcgctctttttcgttgggcgaaagcgaaattccgatgaccggccgtttgcgttcttttgaatacagccaaatcgggaaattgcttaacacgccgccgtcaacgaccgttgaggtgcctttttcggtcttcagttttatcggttcaaaaaaataaggaatgctgcagctcattctgacggctctggcaaccgggaacatctccggatttaatccgtagcggggaagatcgtcaggaagcacgatcatcgttccgttcgtcagatctgaagcgatgagacggagcgagccttttttcaaatcgccgaacgcgatgatgcccttcgcttttaatttatccgcaatccacttttccagcatatcgcctctgtatagtccgaggcgccaatatatcgacacccactgcaggattttcagcgggaggaatgagtatctctgatcaagcaattgccttccgtccacctcatctatgatggaatgaacctctctgctcgtatagcccgcagcgataaatgcggcaataatcgcgccggcgcttgttccggcgagcctttcaaagcgaaagcccttttcttccagcgcttcataagcgccggcaagcgccaccccttttatccccccgcccgaaaatacgccgtcaatctgcatagcgcgccctctcccttccatctcaaggtgtattattattttaagaaacggctgggcgaaatagaccaaagaatgaagacattaaaaaaagggcgccccatttcgggctgccctttattcaccgggattttcggtttttttctgtacggatttcaattcttttttccggctttcgtcatcttcaaaatactgaacgaggtcgccgatgcggtcaatgctgttccagctcagatgatgttcgattccttcaacatcattgtaaatcttctcttcatcaacaccaatgattcttaaaaactgctcaagcaattcgtgtctgtatacgagccgtttgccgatctttttgccttttgacgtcaatacgagcccgcgatatttttcataaatcaaatactcgtctttatctagtttttgaaccattttcgttacagaggaggggtggactgccaaagcttccgcgatatcagaaacccgtgcatatcctttttcttctatcagcatataaatctgttcaatataatcttccatacttggtgttgtcataagtaaccctcccaaaaagcaccttaactttataaaccattacaagtttacactaacggtcatgaaaaaacaaggatgcttccggtctgtcaagccttatcagcgcttataattccattcatcagacgcgtatttcgtctcagccagctcattgacaaatgcaagctcttcagacgtgagtgtgtaaggctcaagatgaatgttcagcccttcctcaaaaccggctttaaaagcgattctggcctcatccatcgttacccgtttcggcgttaaggcgttgatggctaccgctttgtttttgaaattccgctgcatgcgctcacggactctgtcgctcggatataaaaacagatcaaacagcttatcctcatcaatgtcaagcaggatggaaccgtgctgaagaatgacgcctttttggcgtgtctgtgcgcttccggcaactttccgtccttcgacgaccagctcataccacgaaggggcatcaaagcagacggacgagcgcggatttttcaagctttctttttctttctccgttcgcggaatcgcaaagcaggcatcaagtccaaggtttctgaatccctgcagaataccttctgaaatcacccggtacgcctctgtcaccgtggccggcatttccgggtgatcctctgaaacgattacgctgtatgtcaattctttatcatgcagaacaccccgtccgcctgtcggtcttctgacaaacccgaggccgtgtttatgtactgcgtcaaagttaatttccttcttaatattttgaaaatacccgacagacaaagttgccggattccagccgtaaaaacggatcaccggaggaatttttttttggctgtgccaatataaaagcgcttcatccagcgccatgttaaatgccgggctttcattccctgagtcaataaaccgccatgtttctttttccatacactgaacccttctttatcgttttaataaaaccagtttaacaaactgccttgaaaatgaaaaatatttcgtttcattaaggatgacaatcgcttcatgctttactataatagtatttgtcccaaaacgtccggtaagccttgttttcaggaagcagggttttgattttataagctaaaggagtagaattgcattgtctaatatgattgctttaattattgttgcggcgtttatcgtttatatgatcgtttcgtacttttaccagcagcgtttaatgaaaacacttacggaagaggaattccgcgcgggctacagaaaagcgcagctgattgacgtccgtgaaccgaatgaatttgaaggcggtcatattctcggcgcgcgcaacattccgctgtcacagctgaaacagcgcaaaagtgaaatccgtcctgataaacccgtttatctgtactgccaaaacaatgtccgcagcggacgcgcggcacagacgctccgcaaacacggctgcaaagatatttacaacctgaaaggcggatttaaaaaatggggcggaaaaattaaagcaaaaaactaatcatgaaaaaagagctgtccgttttatacggaagctctttttttataccgtgtcagcggctgacgtcaggtgtacgttcgtattttaaaaccggctttctagccgccttggtttcatccattcttttgacaactgttgtatgcggcgcctcctgaacgatttcaggcgattcctccgcttcccgcgcaatttgaatcatggcatctataaacgcatcaagcgtttccttcgattccgtttccgtcggttcgatcatgatgctttcttcaacattgagaggaaaatacacagtcggcggatgatagccgaaatccaaaagccgtttggcaatatcaagcgttcttacgccgagctttttctgccttcttcccgataacacaaattcatgcttgcaatgacggtcaaacgggagatcataataaggcgcgagtcttctcatcatataatttgcatttaaaaccgcgttttcggtcacagcttttaagccgtcaggccccatggaacggatatacgtgtaggctctgacattaatgccgaagttgccgtaataaggttttacgcgcccgatcgactgcggccggtcatagtcaaaagtcaaacggccctcttttttcgtgagaacgggtttcggcagatacggaatgaattcttttttcactccgactggccctgagcccggtcctcccccgccgtgcggcccggtaaatgttttatgcagattaaggtgaacgacgtcaaatcccatatctcccggtcttgctttacttaaaacggcatttaaattcgctccgtcataataaagctttccgccggcctgatggacgatttcagccatttccgtaatgttttcttcaaataacccgagggtgttcggattcgtcagcatcagcgccgctgtttcttcgtttaccgctcttttcaaatcttcaatgtcaaccagcccgtgctcatttgacttaacggtaatcgtttcaaaaccggcgaccgtggcggatgccggattcgtaccgtgggctgaatcagggacaatcaccttcgtccgtccgaagtctccccgcgcttcgtggtaggcgcggatcatcatcaggccggtccattcgccgtgagcgcccgccgcaggctgtagcgtcacctcgtccatgcccgtaatctcctccaagtgtccgcttaaatcgtataaaagctcaagcgccccctgaaccgtgtcctcgtcctgaagcggatgaatagcggagaaacctgcgaaccgggcaattttttcatttaatttcggattgtatttcatcgtacaggagccgagcggataaaagcctgaatcaactccgtggtttctcttagaaagagcggtataatgccgcataatatcaagctctgatacttccggcagctttgcgtcttcatcgcggatatagtcaccgggaagaaggctttcaagctctgtttccggcacatcaagctccggaaggctgtaaccgacacgcccttcgcgggacatttcaaaaataagcgcctgatcttgattattcatgttgatcccccaatcccgcaataagcgaatcgatctcttctttcgttctcagctctgtgacggcaatcagcatatgctgatccagttccggatacgcaagacctaagtcatatccgccgatgatgccgtcttgcaggagccgccggtttgcttccttgacgggaagattcagcctgacggcaaattcattaaatatcgggccgtcaaatgctacgtgcaagccggctttttccgcttggcgtctcgcgtaatcagctttcaatatattttggcgggccatgtctttgacgccgttttttccgagcgccgtcatcgcgactgaagccgctaaagcattcagcgcctgatttgaacaaatgttagacgtggctttgtctcttctgatatgctgctcgcgcgcctgaagggtgagaacaaaacctcttcgcccgttttcatcctctgtttggccgacaagccggcccggcacctttctcatcagttttttcgttactgcaaaatagccgcagtgcgggccgccgaacgccgcaggtatgccgaaaggctgcgcgtctccgacgacaatatcagctccgtatgccccgggcggtgtcaaaataccgagcgcgagcgggtttgaagaaacaatcagctggctgtttcctttatgtgcgagcggctcaatgtcctttaacggctcgatttgtccgaagaagttcggatactgaacgatcacggcggccgtctcatcacaaacggcatgttccaatgcttcaagatctgtgacgccgtttttcgcgggcacctctacaacctcaatatattggccctttgcgtatgttttcaaaacatcccgtgattccggatgaacggctgcggaaataatgatttttttctttttcgtatgtcccgacgcaagcatcgccgcttccgcaagcgccgttcccccgtcgtacatagaggagtttgcgatatccattcccgttaattcacagatcatcgtttgaaattcaaaaatcgcctgcagctccccttgtgaaatttcaggctgataaggcgtatatgccgtgtaaaactctgatcgggatatcacatgatcgacgatgaccggctggtagtgatcgtacactcctgcgcccagaaaagacgcatatgtaacagcgtccttatttttcgccgcaagctttgtcagctctctcgtcagctccgtttcagattttgcttttttaatttggtagtctttttgaaacctcacatcttccggaatatcggcaaacagttcatcaattgtttctgcgccgatggctttcagcatttcttttttatcctgttctgtcgcgggcaaatatcgatgcttcatatgactctcctttttcagctctgttttggacgtttataaaacggtgtgcggactatcttcgcttttaccgtttttttacggatttccacttctacttccgttccgacttcactgaattccgttttgattaaggcaaggccgatatttttctttaaagtcggagattgcgtgcctgtcgtgacttccccgatcggaacaccgtcttttttcacggcgtacccgtgtctcggaatccctttttcaatcatctcaagtccgaccagctttcgcggggctcctttttctttctgttcacgcaatacagatttcccgaaaaaatcggaatctttcttgtgtttcacggcaaatccgattccggcttcaatcggtgtaatatctttcgtcaattcctgaccgtataaagcaagcttcgcttcaaatctcagcgtatcacgggcgccgaggccgcacggaacgaggccttcatgctctcccgctgcaagtatctccttaaatagatgaaccgcatcttcattgcggcaatataactcaaacccgtcttcaccggtatagcctgttcttgaaagcaggacttggcgtccggcaacgtccgcctcgtcaataaatgcaaacggctttaaggaggacagatcacattcagtcagcttcgcaagaaccgactgagcattcggcccctgaacggcaagcagtgaaatcccgtcagactgattcgtcagcgtgacatctccttccgcatgttctgtcagccaggcgatgtctttttcaatattagacgcgtttatcacgagcagatagcagctctcgcttttctgatagatcagcaaatcatcgaccgtaccgccgtcaggatagcacatggcggtataaagcgcgtttcccggctttaaatcggcaacgtcatttgtcatcattttttgcagaaaagacagggcgtctttaccggatacttcaacttcccccatatgagacacatcaaacaggcccgcttttgtgcggacggcttcatgctcctctttaatagaagaaaattgaaccggcagctcccatcctccaaaatcaatcgtttttccgccgtattctttatacacatcataaagcggtgttcgtttcagcatcatcttcccccttcagtcattggcgcttgtaaaaacatataaaaaaggacagagaaacacctcatgaaaatgaaggtttctctgtcccggcacctgaaagtttactttatgaacatatcataaagacgtcccctttggtggcctgcttcttctaagtgcagacactctccagagttgcgtcgagcaagagttcttttgcctgagagattcactccgcagtttgctccttcggcgcccggacgcccatctttcgtccgagtctctccccttgctgtcattcgctcatatttaccaattttatggacatactaaagcaatatcttttagtgaaatcattacttatatcctaccaccctcatttacgtccggcaacaaaaattatgataaatcagttttttaaaagaaaggcggttttgttacatatgacagcagagatcatatttgatgcaaactggccgggagagttttctgagcggctgaaaacggacggtccctggtcaaattgggagctgtacaaactgtcggctgaagtccagcagacccttgccattcctgaatttgaagggttgagagctcctttatacctgcccgatttcactccgcttccccatcagcttgaggtcgcgcagaaagtcgttgaaaaaatgaacggcaaggcgattttggctgatgaagtggggctcggaaaaacggtggaagcgggcctgattttaaaagaatatatgattcgcgggctggccaaaaaaatcctgattcttgtgccggcatcactcgtttcccagtgggtgaaagagcttcaggagaagtttttaatacccgctgttgaacagaagaaaagctatgtgtgggaacagtgcgatatcgtcgtttcttctattgatacggccaaacgctcccctcacaaagacattgtcctttctattccgtatgatctcgtcattattgacgaggcgcacaagctcaaaaacagcaaaacgaaaaattatgaatttgcgagaagtcttgtgaagaaatactgcctgcttctgacggcgacgccgattcaaaaccggatcgaagaaatcttcaatttagtgtcactgttaaagcccggccatttaggaaatgaaagcggatttcaagaaaccttcaatcagaaggacgggattgacgctcatgagcatttgaaagaactcgtcaataaggtgatgatccgcaacacgcggagcgacaccggccttacatggacgaagcgccacgtggaaacagtgccgatcaccttttcaccgacggaacaggcgctttacgatgacattgccgcactgaaaaacggcacggaaaagcccgcaagcgcattttccattatgacgctgcaaagagagtgctgttcaagcagggaagccgtgtatatgacgctcaaaaaaatgcttgaccaaaaagacaaacaagcgcccgcattcgatgaacagacgatcgctaatttaatggaccgcatcaatcaagtcacgcaaaactcaaaagcgattcaagttgttgacttgatccaaaagattaatgataaagtcattatttttactgaatacagggcgacacagatttacctgcaatggttccttcagcagaacggcataagctccgttccgttcagaggcggatttaaacgcggaaaaaaagactggatgaaggatcttttccgcggcaaagtgcaggtgctgatcgctacagaagccggaggcgaagggatcaacctgcaattctgcaaccatattatcaattatgacctcccgtggaacccgatgcggcttgaacaaagaatcggaaggattcacagactcggtcaggaaagagatgtccatatctacaatatggcgacaaaacatacggtggaagagcatatcttaaaacttctgtatgacaaaattcatttatttgaaaatgtcgtcggagaattagatgacattttaacaaaaatcaaagtgagcaattttgaagaccatttgcatgatattttatgccattcgctgacagaggaggaaatgagaatcaaaatggacaatctcacctcttttctgtcgtacggtacggaaaagcccgccagaaaaaaaggctcttaaaaaggaggaagcgcgacatgagacagcaggaggttcaccaatttttactgcgcttttttgaagcgaaccactgcccgattacagaacacgggccgggttttatgacggttcagttgacggtcgagatggacaaacaaattatgaaccgcccgttttattggcattggcgtgaaaaaacgggcggcgaaccgaacccgatgaagattacgttcatcactgataaagaaacggctccggaggatatggacggcgagtttatttactttggagccccgcgcctctttcaaatctttcaagcagttaaacaaaatgggagatttacaagaatatatgagaaaattgtatcagccggagccagagtgccgcttcagccctggcttggattaaatgtagtgatttcataccaatccgacatgaaaaaagacagacttttgtctttaggcctgcatcttgtttctggaacaattatagaagggtttcagcagaagcttgcaccgcttccgctgacctcgcaaatatcagactattgctttaccatatcgccgatgattaagccggaaagcgggattaaaaggatggagcattacttaaaagacgctgccgccaaagagccgtcagactgggctgacagcgcgatcgccagatggaaaaaggacctcaggctgctcgatcagttttatgagcagacagaagaaaaacctgaggaataccatttggaaaaacaagcgctgaaagccttatatcagccgaaaattcacattcagattgaaaacggcggtttatttttcctgcaaagtaatttttctggataagcgttatccattcgacacctttcccgttttttctggaaattctatattataataaaagtatatagaaaaaatttctggcgtttcgcatgcgatgaatcacttccagacatgtaaagataaggtcatgggcggattggctgaaatacataaacaagtattttaggaggagaaaatgcatgaaaaatgcaaaaatggaattttcgcaattagataaggaatgggttgagctgatattagaagcccaaaaagcaaatatcagcctagaagaaatacgcaaatacctgctttcgcataaaaagtcttctcaacatatccaggcagccagaagtcataccgtaaatcctttctgaatgtgctataatatcacaaggaaggtgatgacattgattggccagcgtattaaacaataccgaaaagaaaaaggctactcactatcagaactagctgaaaaagctggggtagcgaagtcttatttaagctcaatagaacgaaatttacagacgaacccctccattcaatttctcgaaaaagtctccgctgttctggacgtctcggttcatactttacttgatgaaaaacatgaaaccgaatacgatggtcaattagatagtgaatgggagaaattagttcgcgatgcgatgacatccggggtatcaaaaaaacaatttcgtgaatttttagattatcaaaaatggagaaaagcgcaaaaagaggagtagtgccgccatatgtgcacaactcctcttttaactgtccgactttcggattagtttttatcctcactgtgagccttttcattttctttgacgtaaccgtctttatccgtatgatctttcttaatggtcaagccgttccattgcgtggcttcaaaagagaattgaagagaaatcgcattgccttggaacttgttttgcacacttaatccgtccgcagtttttgcggtgtcatttttaaattggatttccattctcacctggtcataatcagcaggcgttttcggaactccgtcgtactcaggagctgttttgccgttaatggttgccacattgacttttccgctctcgctcaggaatttcggatcaatgtgcttgctgatcgcttcggcagctgctttatcctgctttgttgacattaagtataagtctttcaggctggccgcctttaaaatgatatttttaggatagccgttgcccccttctttaccgactgtcagaaccgtaatttcaaactggctgaggaaatcctccgcagattcattgcctttctttgctcctttaaagtcagtaaaattcaaagccatcagcacttctttaatggcaagtgaaccgttgtttctgaattcaaaatctttcgtcaatttatcacctggttttaagtttgacaaattgacattggctgattgttctttagccgataaatcaagtgttcctgacgcaaatgtagcgtccgtcgacttcacatcattaaatgcggcccatgtgcctcctcctactaatgctaaaccgagtgcggcagaggcaacgcccaagcttaatttctttttcatacccatgtttgtactccccttactttttattttttgttatcaaatcctgtcgccaggttgcaaccgtattcatgtggagatggttctctttttcgcatgttcttccagcgctttcgttttccgctcaatatcgcggagggcgctgacgatgactgttattgagtaaatcaaaagcatgacgccgggaacgattaacagaatcgccgttccgatcggctggcttgccaaatgtatgacatatcccgcatacggaagctgatatcccgtatactgggccgccactttttcagcttgaacgggggcggcatccggggcggcattatggtccccttttgtctcaaacagcaggttcccgtccttttttgtgatcccgattattctgtgtgtgacggctgttccgtcatcttgcgtaaaggtgatcacatcccctttttttaagtcatttacgtcagaaattttctttaccgctatgagcgaacccgtcttaaattccgggtccattgaacccgacagcacggatttcagcgtatagccgaagatggccggctcacccccggaagcccgggtcgaaatcaccgttaacgtcagcacaataatcaggctgaagatgacggcatacaaaatattactgatcagtttcagcgtttttttcatgttcttccccgctttcttttaccggctcagccggctctttctccgttttcttcagatcggaaacggttgcctgttcccggcatttgacgagtttcatcggttttgaccactcaaattgttcttcgtccgccggatacccttcaggcttgtaaatcttgaatgcgtatatgcccggctgcaaagaccgctttgactcaattttataaatcgttttgctttttttatcagtaataagccctttatccacaacattgccgtttcgtaaaggctgctgctgagaagtgattttatggagctcccatttccagtcagaaacagtccgctcttttcccttattctccagctcggcatagagttgaagcggcgcacacacggtgcctgacgtatcagtttgatttgttatatgtaaatcactctgatcccagcgttcgtcataacggcaatcgtcatccgtatattgaaaatctccgcacgtttgaaccgggagactgaagcttttcacatcattgaaggaggaacttgtatcacctgtgaactgagcacatatcgtcacggacaggcaaaaaatgaacgaaagccgtaaaaatagcatcatccgccatctcaccttgccctttttttccattcgcaacaatcggaacatgccttaccccctgtaaaactgttaataaatatgacaaccgttctctttaaagaacttcatgaacaaagtataatcaaggattatcgtcttgaaaaatgtcaaaatcggtcaatttgttcgtttttgagaatggtatctttcaaaaacatcgttttgcttcaaattacacacctttttggaattttttctaataaaacgtgagaaaataacgaggtgcctagcacaaaatggaaagtatatacagcgaaaggacgaagaatgatgatcacacaaagtctgatttgcctttctcttcttgttttcggggtttcaggaacagctcaggcggaaacggtgccttattatgctgttcaccataaatcaaaatgggaaaagttagcagaaaaagaagctaaaaaaagatatccgctcgcccaaacgttatttattcaaaaggtgtgggaccggaaaagaacggacgaagcagtcaaacaataccacttgacattgcgggatggcgcaaaagaatttggtgtgtttgttacgatttcttttaatccctacagccaaaaggtaaataaaattgccgtcattgaggaataccaataaggccctcctgatacaggaggaccttatgtgtgattcgctttattttttccgctgcatccacagcttaaaactgtacggcaatattccgaaccagtgctgagaagccggcactttcttttctttccgcacttcttttcgctctctccgttcctgtttcggcgtatcgaaatatttaacgaattgctcagtcatatattttacataatcatttgttttcacggctctcacctcatagtgctgtctttactatgaagtgttgtcccgccgcctcttttttatacttccgtccattgaatcagctgtttcttcttctgatcgaacaaaaggtgagcctcccgtctcgtgcctgacactgtttcggcctgaattgtaacctgaaccgtttcccggcgattactcccggtgatgcggaaggaaacagttccgtacggaaaacgctgtgtaccagtttggaccttttgtccctgtgtcatatggcggcttgacagcagcgcgccgttttggagcagattctctccgatccagtactccccggcctctttcgcaaatgtttttcgggtgatgaaatcagatgaagtatagctgatgacaagtaaaactgcggcagaaacaaacagaaccgcgggatagataaaaccgtcagatttgtacatttaatcaccttttaaagagctgtaaaccggaatgaccgcctgattctttttacctgtaacgcttgagatctctaataagagcaggccgtttttcacatcagccgttaatgatgccgcgttttgcaggatcggcacgtggccttttccgtttactcttttccttatcatcttatgataaatttcaaaacgcacttcttcgccccctgttttccggcatgctaacgccaatccgccgtccgccggcttcacagtctcagcctgtttacattcgttcatgatctgctgaacggcaatttgatgctcccggctgtctaatccgccgttatcggtccggtttgataaaaacagatgtaaaatcgggcccagggtgcctgataggaaaagacagactgccaaggagaacaaaacattaagaagcgtaaagccagtctgttttgagaatgctgaggcacatttctttttcgccgcggtcagccgcacacactttgtaatactcaccatcccccttccacttcacaccgggagacggcggcttttttccggtcatcatataagtgctgatatgtttctgaagaagctgatacgcttcctggcgatcttctattttcagaccatctgtcagcatgcctgtccagaccggaatgatagacgtcataaggaacagccaaatggccattgctgatagtgtttcaatagtagagaaccctttatttccgtttagcatggacatttccgctccctaagtaaactgtgatctcataggtgaacccggcgctcttcaatcgaatctttcctcccgaattcggatggcctttttcgttaaattcaaggctctccggtaaagtcacaagtgtaatgtgaagcgaatcaaaagaacgctcgacaatccttccggctgactgcagtttgtatttatgctctcttggaagaaaagtgatttttgttcttttatgttctgcgatagccgtttcctgcgcaagctgaatatctttttgaagctgttctgttttttgccgcacggcaaggtgggtgcagaccggcggaaccgtcgtgaacaaaaccgtcagcaggacggacgccaggcttaacacaatcaggctttcaagaagggtaaacccgttttctgtccgcctgttattgttcaactgtaacttctccgccactaattaagatctgtttaccattcgggcaggctgtattctttttgatatacccctctgattgtaaatcgttcatatccggcattttaccttcatggtcgatttcgtacgccgtcacttgggctttcaccatattctgcagtccttcacagcctttatgctgaatgctttgattatgttttgtaacgttaggaatggtgattaaaagcagaatggaaacgataaataaaacgatcagcatttcaattaaagtaaacccatcttgatttttcagacgaagcactcccttacatttggttcatcatctggtacatcggcatcagcattgacatgtagacaattaaaatcataccggccacaacaccgtaaatgacaggctggagaatgccggtatacttcgccgcgttttgttcaagacgctccatcataaactggctgtacgtataaagttcgcggtgaagcaggccgtttgcctgtccgtggctgactgcagccgcaagatctttttcataacacggatgcccggaaagagcggattctatggtttctccggctttcagacgtgtaatgagcatctctgcttcttcacgataaaaaggcagaaaagattgttctttaaaagctgttaagctgtcatagatagaaaggccggatttcagaagactgctgagctgtaaagagaaaaagtagctgttaaaaagaacggccgcttttcccaagaggggtattttcacaacaatgagcattttatcttgcggggattttttcttacataagaaccaaacgtacaaaaacaagcagaaagcggcggacagcgccagtgcgcaggcttcatgaaaatgccgaaaaaatgcaaagatgaaagcagtcgcaccggatgtattcatattcattgattgataaatcccagaaaactgcggaataattaaactttgcaggatataaaacatgacacagacggaagaaattaaaaacatcggataccggagcatttttttgatttgattcgtctgcatgagctttctctgtaacaaatcgccgctttgtttcatcgcccccggcaattctccgtgtttctccgcgaaatagcagatagagacggcttctttatgaaaagacagtgcctcaagcacttcgtaaaacgcatcaccttccctcagcctgcggattccgtccgtcagctctgcaagctgacgtttatgcagctggagtttcagcagtctgagcccttcaatcagactgtatcctttttccgtcatttcaccgagccttttcaaaaaagccgcttgatccttcaacggccaggttcgtttaatccgcttcatgatacacccaccgatcgtaattgtcggttgtgacatagccgagcgcgattccttttctgatcagcctgcggagcgtctgatattgaaaattggcgtgctctccctttgcttcctgaaagcattgggtgaggtttttcccgtagagcagttcataaatgcccgcacggcgggtctgcctgtacatccggcagtacacggaacagttttcctctttgcagaacggacatgttaaatcaaccagacgctgagcggcaatggcaatgacggtttgttcaatttctgtcatgttcaccccaaactccagcagcctgtatatggcgcccttagcatctcttgtatgcaggcttgaaagaacgaggtgtcccgtcatggccgcgcggactgcgatttcagccgtttcggcatctctgatttcccctaagatgatcatatcgggatcatgtcttaaaatcgcttttaaaccggcggaatatgtgactccggctttttcattcacctgaacttgcaacacatcctcatctcttgtttctacggggtcttcaagcgtgacaatccgccggttgaaatgccgttttgcatagttgacaagcgagtaaagagtggtcgtttttccagagccggtcgggccggtaaacagaagcaggccgtgtgaatgcttcagaaaggacaatagtgcggcgcccgccccccgaaataaggacagtttatccagagggggaatctgccgcttaggcaaaagcctgatgacaagactttcatcattcattgtcggcaaggttgacattctcaaatgaacggtttccgtcggaagcggcagagacaatgaaccgttttgcggcttacgtctttctcctatatccatggccgataaaaacttgaaatgagaaataagccttacgcattcctctttttttaagactctttttttcacaagagcatggccgatgcgaaaatgaatgaaagcatccttttctctcggcacaatgtgtatatctgaagcccttgccgtataggcctcgtttatgatgttcctgctgtatgtttcaatatttttcacaagacttccctccttccgcacgtattgtaaatcagatacacaaaagccggcaaaggagagattatgcgttttacactgtgtaaaacgcaaaaaaataaaaaataagccccctgacattgatttactgaatgaaatccggaaccattcggccattttcagccatcaaaaaagcaggcgtatgcctgctcttcttagcgtttcttttctttccgcaaatattttttttgatgctccctcaaaatgtcccctgtccagcctttctgccgcaaataaatataaatcagcagggttgatacaataatgagcacgatggaacagatatacgcatatttccaatgaagctccggcatgttatcaaagttcatcccccagagagctccaagcgccgtcatcggtgtaaagagagttgtaaaaatcgtcaaggctttcacaatttcatttcctctttgggaggtaatgacttcctcggcgtgcagcagattgctcagttcctgatcaaactcattgatatatgtaatccctctttccatcttatgatgagctctgaggtaatctttctgcctgtcatttttcggaagaaacgcttcttttaaagccatttccacttttttagcccccagtgtaaggcctttccaaatgaacagctcatggcgcagtttatgcacattttccaagattcctttgctgttgtcatcatgaatctgccatttcagcgtccgctgcttgacttcaaattcatccagtccgatcagataggaattcatcagctctcccagcagaacaaaaaagccttcaatcggattttcacaggtttgaatctgctgtgtggcatgcttttcttttacaccgcgcagcagcgaaaaatcaaaattaatcgtaaaaaagaagtctctcgtaatataaaagtgaaatacggtatggtttttttcatcatctaatccttgatgatagattaaagatccgaaaaccgcttcattattctgatcatttgtatctgagcgcagaaagtttatatgattttcatgttcaaaccacttttcgcattgcggccagtgattgtgatggatcatttttttcgcttccgttttttcatgcggaccgagctggtaccacagccagtccgcacccgaatgtaccttcatctcttgtcatcctccagtatcgctttcttgttttattaccgtaaatgaggcgggctaaaccaggttcgatgtttgagcagctttctacagtggtattattccgaaaaaagggaggtgcaagccttccttcgcggaaggcgttacattgtatatcatcaaactatccgccatcgtactatttatattattaacggcgtgttttgtcgccatagagttttcaatcgttaaagcaaggcgctcccgtattaatcagctcattgaggaagatgtaaaaggagcaaaagcagccaagcatgtcattacacacctcgatgaatatttatcggcgtgccaattgggcatcaccgtcaccgctttggggatcggctggctgggtgaaccgacagtcaaagcaatgcttcagccgttatttttaaagaccggagttcacgaagcggttgcccaagtactgtcattgatcatcgcctttctgctggttacatatgtgaatgtcgtcatcggcgaactcgccccgaaaagttttgctatccaaaaagccgagcggattacacttttgtctgccagaccgatgattttgttttataagttaatgtttccgttcatctggctgctcaatcattccgcccgcctgattacagccatgttcggcttgaagcctgcttccgaacatgaaatggcttatacggaagaggaattgcgggtgctccttgccgaaagctatcgaagcggcatgatcaaaaaaagtgagctgcattacgtaaataacatttttacatttgataagcgcactgccaaagaaattatggtgccccggaatgaaatggtgagcctgccgttagacagcggatcgggacatatgctccgggacattatcaaaacaaataaatatacccggtatcccgtcgtaaaaggagataaagatcatgtagtcggcatcatcaatataaaagaagttttattcagattcctgtcagaaggagcggcgtttacaaaacacgaactcagcccttacattcagccggcgatccatgtgattgagacgattccgatttatcaattgttcgttaaaatgcagcgggaacacgcccatatggccattctcattgatgaatacggcggaaccgcggggttagtaacggcggaagatatcattgaagagatcgtcggcgaaatccgcgacgaatttgatacggacgaaacaccttccgttcaaaagcttgggaagaaccgctatctcctgaacgccaaattgctgatcagtgacgtcaatgatttactcggaacagagattacggctgatcaagtcgatacactggggggctggtttcttactcagcatattgacgcgaagcccgggagcaccattgattttgaaggctacacatttacggtaaaagaaatcgacagccatcatatcatgacgattgaagctgacaaagctgaatagctgagggagaaatccctcccggccattcagctttttatcatcttaatgattcttttacgataaatccgttttttgccagcgccttcgccagactctgctccgttttcacctgagaaaaatcgatgccgagcttcacgacggtctgcgcgatttccggcctgatgcctgagattgtcgtttctatgccgagaagttttgtgctgtcaatcactttgaaaatctgataagcgaccatcgtatccacaatcggcacacctgatatatctaaaaataaataagaaagccggagtgaagaacattggtcaagcaccgattccaaaatcatttttgcccggtaggtatcaatttcgccgacaagcggcaaaattccaataccggcggcaatcggcataatcggcgcgctcagttcgttaatcatttccttttgggcgtttaattgtgtaaccgtcactttataatattcctctgtaaatacttcaatcatatggtcaattgctttgttcagcttctctccccaatggaataccgcattcgccccgggcttctcagacatcgtttcgcagcatgtctgtatacggttccagaccaatctccggaattctttaaagctcgtgacgctttcatagaccggtacttcatggacggcccggtcccttgcgaactgaagcgcccactttgtcagctcctcttctccgccttctttttccgataaaatgccggcaacgatttcaattaacagacggtgctgcatttccgctttctgatcatctgaaggccgccccgattttggtatgagcagccactggcgtgtgatttcacctgattcttcaattaaggttcgagataatgtttcattcaaatgtttcacgggtctcctccattcaaattactttgtatgtataaatcggcgccggacgcacatactgtaattacatccgatgggctatagccaagcggtaaggcaatggactttgactccgtgatcgttggttcgaatccagctagcccagtcccgcaaccgcaaaaaacgaagattagctgataaatttgatcagcggatcttcgtttttctcttatgatacagattgatgtaccgtttttttcttcgtcagcttcatcagttctcccggattgtatccgataacgagcttattgcgatcgatcagaatcggacgccgcagcagtttcggcttctcagtcaaaagcttcagcacttcatttacagtcatttcttcaatgttgaggttgaggtttttaaatgtttggcttctcgtcgccaatatttcatcaattccttcggtcgttaatgataagatctgtttcaattcatcaattgtcggtgtctccctgaatagatgtcgctcttgaaagtcaacattgtgggcttttaaccaatgtttcgtttttcggcatgatgtgcagctcgggtatgaataaaaaataagttctttcatttttaaaaattcctccctcggataatccgtctctttgttaacataagtaccctgaactttttttccctaaacgtatttcaaaaagatttttcggatcttttttagagaacggcataagatataaaacacagggaaagacataaattccacaataaatataatcatgaaaatgtttacattttgagtgccgatctattataataaacttcagatagactctcgggaggggataaggaatgaatcgcatgttccgggtgttaggattttggacggggatatttgcagtcatgttttttctagggggcatgaaagacgcttctcttttgttttttggacagacgatctttttcgtatttctttcttatttgaatctgactgagcggatgtatatttatattttcggagcttacttaaccgtatttttcgccggatttacatactactctatttttattatgacaccgggcggcggaacccactgaacagaaaaagacagaccgattatggtctgtcttttttcatttacagtgaaaaaccattgataaacgggtttcgctcctgctctgtctggatgtccgtttccggcccgtgcccgcttaacacaagtgtatgtccgggaagcgtgagcagtttttgatgaatggaatcaagcaatacgtcctgacttccgccgtgtaaatcagttcggccgatgcctccctgaaagagcacatcacctgaaatcaccagatccgcgtccttcacataataagaaacgcttcccggtgaatgtcccggcgtaaacaatgtctccaaatggaaaggcccgatgtccaaaatgccgtcgccttcgatgagccgttcggcgggccgtgccgttacggcgatgccccgcaatatgcctgatccgtttaaggaagagtcctccagccacttttcttcatttttgtgaaggtatacgggaacatcccatctgtctcttacttcgtcaagtgcgccgatatggtcaaaatgagcgtgcgtcagtaagatggccagcggcttcagattgttttcttttatgtaattgttgattttgtccgcttccccgcccggatcaaaaataagacaggactgatcctcactgacaagaaaatacgcgtttgcctgaatcggcccggccggcattcgtctccatttcactttcatcacctctttatgtatatgcccttattatgaaggttttctgcggaagattcaatgaatgcggccgggaaaacgctatcgacaaacaaaatgaaaacggttaaaatgaaatggaaagattttcaggttccaatgacaaaggaggagcatgatgttacttgttgtaatcttcggccttgtcgcattattagctgtattaggagtcctgcgggctgtcagacagagaaatatcctgggatttttgttagccgccgccacgctgggcgtgtttggctggtttaccgtaatgaccgttgtaaccagcggctatccgactgcacattaaaagcctgtatccaatggatacaggcttattttttattgctgcaaatgtttgctgacacttttgattttgctctccagcgtcgtttctttatcacgtctgtcatcaatgcggatatttgtcgccactctgtgcagccctttttggaacggggcttcgtgaatatcctgaatgactgcgaataagtcgctcagctcaccttcaatcaacgtgttcatcggcgtgagctgaaatttgattttgccggcagctttgtaaccctccaaaattttttgcacatccgctacatactcactgacgctcggtgtttttgttccgatcggaatgattgtgacatctgcaattgccatttggttcaaactcctttttcatttgttatgattggttctgtcatgcccgttttcagtgaaatcagacggtcatacgtaaagccgtataaagcgtattccccgttcggagagatctgaatcggctccatttccgtgtttttgagcaccgtccgctcccgttcgtctcctaagtcaaagctgatcagattgtaagagcggccttcaggcttaaatatgtaaaaccgcttgtgtgtctgatcgtaatcatattccatcggcgcgaagctctcatactttttttggagaggaaagcggtgtgtcacggatgccggcttttggaaaaagaactcgccgtctccgtccgattgatccgttggtctgacggcaatcgtcatgcccgggcgggaatcagcccagatgacgtgatgaagcactcttttttcttttttcgtctgcaagtcataagaatataaaggaccctcttcctccgtttttccttgcttgatatattggaattcatcagtggaggtccaatggacaaaaggggcctgaacgggactcttttttaaaatgccgttgttcatatcggccgtataggctgtgaagtcccatgtttcagtaaaaacggtaatcatcatttgatacgggtcatacggattccaagccgtctccagctcataagagttaaaggctttgtgataaagtcttttcccctgcttgttcataagcacaagctcagtctgaccgctgcttgtcacctgtacgagaatcagctgttttttccggctgatctttacattgacaatattgccctttgtttcatagagccgttcggattttccgctgaaaagatcatatttcatcagctgatgatgtgctgtatacagaattgttctgttatccagccatccttccgttttttccgcttcctttttactgagcggaacgattttctgttctgccgattttgccgaaacgcctgtgtcttgctgctgatgagatggttcacaggccgctaaacacagaacgaatgcggacagcagaacacaaaccaagtatctcatcagccttccctccattcttttctattgtcccatatttgtttatgtaaacaaatgagaaatttcacagatgtctcaaaaaacaagcgacctccacaaaataccttccgtcgcttgataaatatcagcaaactgatgaaaaggcaaagggttttttcccttcccgagctcaatggtatagccctcttttccatactgctgtataaaccaatccctaaaaccggcatggctgtcaatggttttaacgccttgatagcggtttccgcttatcgcttcaaactcccgaatcatctgggatgattgctccggttcacatccttcgtatccccagtaaatctcttctccctgcgtatgaagcgcgatcagccggtcaggtggctgttccgttatcagccggtgcatcgcctgcgcctccggttcagtgagcggcgccgttcctggaaaatcacggtatgaaggggctttcggtttgcgcctttgttcaatatcccaattggatgggaaatgtttatttaaatccacaccgtttatattcgccttccattcgcggaaatccgggcggtgctcatttaattcgttgaggaattcttttttttctgataaatcttcacatccgtaaagtacgagatcaacaccgtcgggatttacgagcggaacgaatgacaatgatgtccggctgaatatatcaagcacagactgcccgaaaacggttttattttcgcataatgccacggaatattctttacaccatttaagcgcgaccgaggtggtgatccattcattggcatgaaatgaggcgtttacatggacttttctttcggccgtatccgcacctattttcagctcataaagcggctttcccaatacggaactgccgattttacggcatgtgacaaacggaaagacatccgttattttctcaatttcttcataaaccgattcggagccgtacaccttttcttccttcacccattgatcagcggaaagaacgctttcacagtgccggatgtatcgcgaaagcccgctcagcgtctcaagcggcggaccctctgactgcccgctcacggcaaagccgggacaaaataattcatcgctttccgccgttttatcagcggctttcaacagtttttcatcaattgaaagcacctttgcaatatctttcatatgctgtttcaattcaggtttgacacgaattcccgccatgttcatcccccttttttaaaaactatatgacaggggagataaaaaaagaaagccgcccgcgatatgggcaggcagactttcttcagcagttttgatgtttgagccattcatttttggcaatccacgccccgccgatgactccggcgtcatttccaagtgccgcaatcgaaatatcggccgcttccgcagaacgcgggaacgcggtgattttgaaggtctcttccacttttgaccgcaggatttcccccgctttagacacgcctccgccgagcacgatttttgtcggattcatggcgcttgccagatttccgagcacgaggcctaaatgttttgcgacataatcgacgacttcaagcgcggtcttatcctgctgtttagccgcttcgaacacgtcacgtgccgtcagatcgcgcacttgtaagagcgaagagtcggaaaccgccgcaagcttttctttcgcgatgcggacgatgccggttgcggacgcaatcgtttcgatgcagccggattttccgcaattgcacggagctcctccttccggaatactgcaaatatgaccgatttctccgccggccccgtttttaccgtgaacgatttctccgttgacgatgatgcctccgccgactccggttccgagcgtcactaaaatgacatctttggccccgtcacctgcacccttccacatttctccgagcgccgcgatattggcatcgttttcaatgacggccggaatacccgtttccgcctcgagatggtctttcagcggatagtttttccaccccatatttgtcgtctcatagaccattcccgtcgtcatttccacaggtccgggcgctcccattccgatccattttacaatccgtttcggcttgttcagttcttccagcttctgatcaagcgctttggcgatcgtgaccgtaattgtgtttccggatttatcggtcggaacttcccatttatgctgaatttcaccgtacatgttgataaaggccagcttgatggttgttccgcccagatcaatccccgcaaaccatgtatcttccataataatctccttttcttattaaaatcctgctgtgttaactgcctctgatccgctccgattctctctgaagaactccggcggctttttgccataaatctctttcaatcacgtttgacaagtacatttcctttaattcatctttcataaagtcaatttcggcttgtctgtcaccgaaataaacaatatgtccgaatgacttaaacagctgctgcacgtcataaaatgaattcatcttcttcaccatttctattcttcttagtataagcgtatttcatcactgatccgggcgtcaagcaaaaaacgattggagaaaatatccttgtattattttcataaattgtatattcacaattgtaaaaaaacactcatttatgcgtttttctgttacaatactttcgtgcccaaaagcacaaaaggattaaagtttgatggggtgttgttttgaaacaagaaaaaaggctgacgttcatctcagccatcagtttatttgtcttgatgttagcagtcattatttcctgcctgtttttctttcatacagagccgcatatgccgctgttcttttgcgtcattattctgtctctggcaggtttgtggctcggtttctcgtgggagagtcttgaaaaaggaattgtcagcggattaaaaaacggggtgcagccgattatcgtgctggctttgatcggtgtgctgatcggcgcctggatgtacagcggcgccattcccaccgtcaccgtttacgctttgtcaattatacagccgagtcagctgcttttgaccgcattattttcctgcatgattatcagcacgcttgtcggctcaagtctgacaactgtcagtacaatcggcgtcgcgctgttaggggtagcaagcgcggcgggagttccgctcgaatggacggcgggagcagttatttgcggagcttgtttcggtgataaaatgtcaccgatgtccgacacgacgaattttgccgccggaatcggcgaaattccgatttttaagcatattcgccatatgatgggcaccaccgttccggcactgctgatcacgatcgttcttttttatattctcggttcatctgtttcaataaatgccgcttcaacgcaaaatattgaggcggtcatttccggaataaaagaggccgtgcacgttacgccttggtcgcttctttcacctctgttagtgatcattttagctgtgagacgggtttccgtgattccggtgcttaccgccggtattatttccgcagggcttctgactgctgtttttattcctgacagcagcattcaaggatttatatccgccctgcaaagcgggacggcgtttaaaaccggcgaccaggctgtggccagcattatcaacagaggcgggctccaatcgatgatgggatcagtctctctgattatgatcgcctttgcgctcggcggcctgatggaaaaaacgggcctgatcgcggcgctgcttcaaggattgataaaaggcgtgcatacgaaaggacgtcttgtcatggcgaccgtcttctcaagtataggcgtaaaccttgcgacaggtgagcagtatttgtcgatcttaattccgggtcaatcttataaacctttatatgacaagctcggcattaagcggattcaccttgcgcggtcgcttgaggacggcggaactttgatcaacccgctgattccctggggagtaagcggcgcttttatggcaagcgcattaggggtttccgtcgtcgactacctgccgtttacctttttcctgtacatttctcctataatctcaattctgctcggtttcctgaaaaaaagctgacaatacgagaaaacctgccgttttttaccggcaggttttcttatgcaaaaaatcccgcttaaaaaacgggatttgtttaaaatgcctgctgaatgaatttgtttctgataaacggtatttttaaaaagaaatgaatgaatgtccgtctgatccccggctggctgagcacgctgttcatcagacggtagcggttttggtaaacggctaaaacagatacggcgcataatgagtagatcaacaattttttcatcttatccctcctgcccctatcgtttgtcaaacagcgagaattattccggtgcaaaaagttttttatgcgattaagcgatggtttcagattcagtcacgatcatatcgaccggaatatcgtggggcatgcggggaatgcggtctgtcagctggcagtcaaagagaagcgacacggtacggcctttataaccggacaggtaccgatcataatatcctccgccgtatccgattctgaagccttcccggtcaaaagccacgccgggcacaatcacaaggtcaatgtcattttgggcggctttttccgtcagactctcgatcggttcgctgaggcccgcatatacggtttccagctgatcatacgcagaaaatgtacggaactccattgctcccgtctgcggaaagcattttgggatacagacttgttttttctcttgccaggcctgttcaataatcggccgtgtcggaatttccaggcgtgtcgagatggtaacggcgatcacgcgggcctgtctccattcttttaaagaaaacagcgtttcacgcatgctgcggcattttttctcccattcactttctgtcatgtcagaaagctttgcttttatatcggttctgatttgtgctttcacgtttctcaaacctccctgaaagacaaaaaagccagaactttattgaaagctccagctttttccgctgtgttaaacagcttattttgtttcacggtgtaacgtagattttttatcacgtgggcaatattttttaaattcaacgcggtccggattgttgcgtttgttctttttagaaatatagttacgctcaccacattcagtgcaagccaaagtaatattaacgcgcattattttccctccaaactaaatatcatttacttattcagacttatatataataccactataatggacggaatgctagagctgatttacatgaaatgttgtttaagtgcagaaaacatcagtttacgcttctgatcctctgaatgagcttgcgtcagaagaaggtaaaatatgacgaaacaggacaaaaaagggctttctgatacgaaatctatagagaaataaccgtttgctccccgagtaaaaaagattttccgacaaaattccgtttttttctctatttcctttagaatggcggcgttttatggtataaaaaagaagggcaaattaataatagaaggtgatgaaacgtggaaattgctattattgcgttgtttatcgtcagtatagcgcttattgcattctcatattctcaaagagatccgatgaaagacgtggaacaggagctagaaacgcttcagctttccgccatgcaggaaatttacaagttgaaaaagaaaatgacggtgcttgaagaagaattgctggaaaccaacctcgtgatccgcaaagccaaaagcagcggcataaaccaaaaaatcgccaaacaaatcatttcaaaatataacaacggaatgtctgcggaagccatcgcaaaagcggagcacgtgtctgtcgaggacgtcaataccattattaaagataatgagaaggtgctcgtatgacaaaacggggcattcaggcttttgcagcaggcatgattttagcgacggccgttctcgccgctgtcttctatttgactgaccatgaccaggcagccgccgttaaaaccgaaaaaacagcattgacagaaaaagaagtaaacagctacctcgacgatcagcataaagtctccgtcaaccgggatgactatcaaaaactgcttgattctaaagaaaaatcgttaaacaacgaccaaaacacagacgccaaaaagaaaaaagtaacatacaaactgacgattaaagacggaatgagcactgctgatgtgtcatccattcttgaaaaagaagggattattccttcagcgaaagacttcaatgattacgtcattgacgcaggctaccacaaagaaatccgcgccggccatttcaaagtcgattcagatatgagctttaaaaaaatcgtcaaaacattaacccgctaaaaaagcttgcaggcatcgtccattcagatggatacggccggcaggcttttttaatagacatataaaacggacccggttaatggccgggcccgtttttttcatccgaattttccggtgatataatcatgtgttttttgatgatccggctgagaaaatattttgcccgtatcgccccactccaccagttcgcccatatagaaaaacgcggtttgatcagagaccctcgcagcctgctgcatgttatgagtcacaatgacgattgtatacttttctttcaatgtcaaaatcagctcttctattttccgcgtggacacgggatcaagagcggacgtcggttcatccatcagaaggacgtccggtttggtggcgagcgctcttgcgatgcacagccgctgctgctgaccgcctgacagtgaaagcgcctgttggtgaaggcgatccttcacttcatcccagagcgcagctgcttttaaagattcctcggcgatttcaagcagtttctttttatttttttcgccgtgaattctcggaccgtacacgacattctcaaatattgactggggaaacggattgcctttttgaaacaccataccgatctgttttcttaattctgccgcatccgtcttttccttcagcagattgcgcccgttatagatcatgtcgcctgtcactttgacattcggggccatttgcagcattaagtttaatgttttaataaaagtggatttcccgcagccggacggaccgatgatcgcagttaccttccgctcctcaaaaccgatcgtaatgtcttttaaagcctgatgggctccgtaccatacgttcatgccgtgaatatcaaataaattctgtgtgtgcaccgcttccttcacaagactcacagtccttccccctatccgaactttccgttaatgtagtcatctgtcttttgcgctttaggactcgtgaaaatttgttctgtctgcccgtattccaccacttccccgtttaaaaagaaagccgttcggtcagacaccctcagcgcctgctgcatgttatgcgtaacgataataatcgaataatcttttttcagttctgtcaaaagcgtctcgattctggcgtttgaaatagggtccagagctgaagccggttcatctaaaagaagcacggcaggtttcatcgccagcgtacgggcgatacaaaggcgctgctgctggccgcctgataacgacagagccgatgaatgaagccggtctttgacttcatcccaaagcgccgccttcgttaagctttcctcgaccgcctcatccaaaacggctttcctgcgttcccccgcatacttcagcgcatgtgtgatgttattgtaaatggatttcgggaacggattcggtttttgaaacaccataccgatttcccgtctgagagacacgacattaatcgcttcacccaaaatattcagcccttcataaaggatctctccctcgcttcttgccgaagcaatggcatcgttcattctgttaatctgtctcaaaaatgttgatttcccgcagcctgacggaccgatcagagccgtcaccgcatgtttttcaatattcatgtttacatcttttaccgcttgtttgtcaccgtaataaattgataaatgcttcacttccaaaatcgaagactccggcaaacgctttgtctgttccgcttgttccctgatgatgtgatcgatcatgttttcgcctctttccgattaatttgccgtaagctttttataaatgacagacccgagccatctcgcagaaaggttaaacaagagaaccgaaatcaccagcaccgccgagccgccgtttgcaatcgcttcggcgtcagggatgattccctgcgtattgacactccatatatgaaccgccagcgtctcagccggcctgaaaatgttgaaaggagatgattcagaaaatgggttcaaatccgtaaagttcagccgcggcgttgtcagccccgctgtaaataacaatgcggccgcttctccgaatactcttcctgatgccagaatggctccggttaaaattgaaggaatcgcactcggaatcagcaccgttttgacggtatgccatctcgatacgcctaaagcgagagaagcttctttcagctccttagggactgcagtgagcgcgccttctgtcacccggaccataacgggaaggttaaagaccgttaatgcgagcgcgcccccgataatcgtgtagccccatccggtcaggtttacaaacatcagcatgccgaacatcccgatgacaatggacggaagcgaagacagcacctcaatacacgttctgataaaatcggtgattttattttggggcgcatattcagccataaagacgccgcccccacaccaagcggtatcgtgatcagcatggtgataaacagaatgtaaaaggagttaaaaagctgatcccgtattccgccgcctgaggcaatggcgctcgattttgacgtaagaaaacgcaaggagatttcagagacgccgtgaataagaatgtacaaaaacaatcctgccaaaatcgccgcgattacagcggcgcataacccgaatacaccggtggccaatttatccgttattttccggttcattacactttcctcctagatgacaagtagcgtatgagcaatataaacagaaacgacatgatgagaagaacaagccccatagaccataacgtattattttcaatactgccgtatgtggtatggcccatgtttaacgtgataatcgtcgttaatgttcccgccgtatcaagcaggctttccggcagaagctttgtatttccgataaccatctgtacggcgagtgcttctccgaacgctcttgccatcccgagcacgacagcggtcagcaatgtcggaaacgccgccgggataagcacctttctgattgtctgccacctcgtcgccccaagcgcatatgaaccgtcgcgaaggtgtttcggaagtgacgcaagcgcatcagcggaaatcgatgtaacagtcggcagaatcattaccgagagtacgatcgtccccgccagaaggctgtgacccgttccgcttgatttaaaagagccgataaacggaaccaatactgtaagacctatgaatccataaacgacggacggaatgccgacaagcagctcaattaccggctgcagcaccttttttccccaagtcggcgcaatttccgtcataaacacggcacccgcaataccgaggggcgctgcgatcagagcggacagaatcgtgaccgcaaatgatccgaaaataaaaggcagcgcgccgaactcaggttttgcctgggttggattccaattcagacttgttaagaactcaatcgggcttacaccatttacaaaaaaagattgcagcccctttatgccgagaaaaattgtgatcgccgctgatgccgcaatgataatcgcggcacacacagacacaatcacccttccgcggacttcatccaattgcctgttttgttttgagcttattaagcgttcgcttacagactctttttctctgtgatttatcatttgtttacactcctataaagaagaagaggcggggagcccgccctcccctcagctttgcttgccgtttgcgtcacgtgtgactttcatatcagagatcggaatgtagccctgatcttttacgatacttttctgtacttcatcgctgttcatatagtcaagaaacgtttttgtaaggcctgacgcttcacctttcgtataagagtgctcgtaagcccaaatcggatactcgcctgtgacgacgtttttctcttccggtttgatgcctccgatcgataaaggcgttactttgtcatcgtttatataagagaatgccagataaccgattgctcccggcgtttccgcaatgatttttttgactgtattggaggaatcctctgtaatgccctctgcaggctctgctccgtcaagagcatatttgacgaacgtagcgcgtgttccagatgaatcaggacggttcacgagtgtaattttttgatctttaccgccaagctctttccagtttttaattttacctgtaaagacgtctgtcagctgttttttggttatatcctttacgcccgcaccggggttgaccgcagccgccatcgccactaccgctactcggtggtcttttagggctttcgcatcaatgccttctttttcttcagcgaagacatctgagttgccgatttgcactgcccttcagacacttgcgaaagtcctgttcctgaacctcccgcttgcacctgcacatcagcatccggatgtttttccataaacttttccgccgctgccagtactaacggctgcatggctgatgaaccagaaatggttaaagaacctgatgcttttttatcctcacttgcagattgactgtctgtcttgccgctttcctttgcatttccgcatgctgcagcaacaatcataacagcagccatcagaagcataagcatccatttgttttttttcatttcctgaattccccctgcatttaatgtgtaatttgtcctacacgtatagagtaaagggttcttgtaaaatgcgtataaatcaagtgttaaggttttgtaaatccggatgtttttttgtataaaaaaaacgctcacaggttgtgagcgtttttctgttagttgcttgtattgccgttttcagcgtcttcctgaattttatcttcgtttttctgcttcgtattattatcttcttgtttctttttcagctcaaagtatttgtccagagctgctcttcctatatcattcgtaatcgaatatcgatcgctgtaattaatataggcccaaggaacgactacagaaatagccacttccggattatcagcaggtgcatacgcgacaagagtcgtattatacgttccttcacccgtctctgatttgtcaggaccgtcatagaaagattgcgccgtacccgttttaccggcaggactgtatgtcgccgtcgcaaaatcagttgcggctgtcccttttgtcatgacacgtctgaaacctgcctgcacttctttaatgtctgcatgattcatatcaatcttgttcagtacttggggctgaacagactctacaacggctccgattccttttttcgaatcaggctgtctgacctcttttacaagctgaggtttcaaacgatagcctccattggcgatcgttgatacatactgcgccatttgcagcggtgtaaacgtatcatactgcccgatggcaaagtctaacagaagaccggaaattcgctgtgtcccttggtacccggttgcttcattcggaagatcaatcccagtcttaactccgagtccgaactgattgaagtagtatctgaaagtatcgaatgccttcatatcaagcggaagggactggccttttttgtactcccctttaccgacagcaatcgccgttttgaacatgaacacgtttgaggattcctgaagcgctttttggatatctacgggacctaaattggtccatgattttttcgggtttttacttcccttgaaatacataggttcatcctggaaaacggtgttcaaattaatcgcgcccgtctgcagtccggtcaacaccgtcgctcctttgaccgccgatcccattgcgtaggaggaagtcattgcgccgagggcataatcattaattttgtactttccatgatcattcgtaatctgtttgccggccatcgtcagcacttctccgtttttcgggttcatcatgacgacgaaggcccgatcaagaagcttcgtgctcggtctcgcttttgccgatcttaaatttttctcaatgattttttcaacggatttctgcaggtccatatcaatggataatacaaggtctttgccggcctgtccttttgaaatcactttgctgcccgtgacatttccggatgagtcggttaagttctgcactttctctttttgaccctgcagcaggctttcatattgatattctaaatagctttttccgaccctgtcattccggctgtagccgagtgacagatagtgatccagcagattggaaggaagaccttcgttcgcactggatacactgccgagcaatgtccggatcaggcttttataaggataagaccgttcccagtcagacgtcacgtcaactcccggcagttcatctaaatgttcgctgacgacggccatttcttttgccgacaccccttcatttttgatgtattgaggcgtcagtgagtagcctgaatccatctgccttttgatcgcaaggatctgcatatcttttgaagtgagctcattcagctgtttgtctgtgatacgtttcagctgaagctgatataaatcatcttcagacagttttttgtcttcagctttttgcttttcttcggccgtaatcagttttttcgcttcatcaggcctcgttaacatccaatagtcttttttatcccgctcagtcacctttttggtgcttaccttaatcatacccgacagtttttttgcgatttttaaacgctgcgcctgggtggttgaggctgaacgtgtatatgtaatcgcatttaatgctttattcgttacgatgggatttaggttccggtcgtatattttccctctcggaaccgccgtgctgacatcagactcctcctgcttattagcggcgtttttataatcatcaccctgaacgatctgcttgatgccaagctcgacgataatccaagtgaaaataagaaacgcggccaaaaacaaaaaattaagccggatcggcagtgattttttcttttctttgtttacagctattttctttttatttctcctcatgacatcaccttttcttatttacagaaagaaatgacaccttctgttcaggtgtcatttttcattctaaaggttttttcgatatttttctacagataacccttttatctttctccttttataaaattcggttccgccgcctgtttttgtcggtcttcttctactgtttcatcagaagtttccgtatccagtctgatgtcttttataaagtaataaatcagcggatggccggctccgagcagcacgagcgccgccggtattcccactttttccttgaataatgtaacgattacaaggaaacaaaggatggaaacgatcctgcccgcatttaaaaataactccctgagcacaatgtattcaattctggcttttctggcaagccgcgcccggcctatcacatcatatgtaagcgagacatacggcacgagcagaactggatagccgatcgcaataaacactccgtacaaaaggagcgtcgtgaagctcattttaaaaatgataagaaacagggcaccgtacaagatcaatccgccgataagaatcgcctttttccgagctctttttttgatgagccttgatgcaaaataataggcaaaaaaagaaaccgcggaattgacgagaccgaatgttccgagcgccagctcactgtttgtcgcaatgaatacaaaaacgctgattaaaaaaacaaaaatcccttctctcaagccttgaaaaaagtgcgcgttggtaatccggcgccaattcagattcgtgtggcgctcatcaaaaacttttttcagcataaaccggcctttcgactccctccgcttcagaaaaaagctcatgaccacggcaagggcaaataagccgagcgacaggctgaaaatgattgtataacccgtattgttttcaagtcttgaaatgacatatccggccacaatcggaccgatcatgcccgccgatgaagacaaaatgcctaaaaacccgttaaaaaaatctctcgtttccggttccgtaatttcgaacgtcagcacattaaaagccagccagtaaaagccgtatccaactccgagcacggcccctatcaaaacgagacgggaagccgcagtttctccagcaagcagcacacttaaataaaaagcggccaaaaagataacgccgaacctgagaataaacaccctgtcaatttttttagccagccggccggccagcagaaaggtaaccggctgcatcgttacgaccgacaaattgtatatggccaaatcaataaattttcccgactgcttccacaaatacacgttgacaaatgtatttgacagcgcgatgcccaatgagtaaaggccgccaatcgtcaataacagcagcagccctttatttatttcgatgtcgccgataattttttttattttgctcatcattgactcccctttactacacattagtttgtctcactcaaactgagatatgtaaaaggattcaaagtcaataaaaaaacaaggcctcccgcgggagaccttgtttgatcgaactatttattttgcttcgctgtaaagacgggcaacttcatcccagttcacaacattccagaaagctgaaatgtaatcaggacggcggttttggtagttcaggtagtacgcatgctcccaaacatcaagaccgaggacaggtgttttaccctctgaaagcggtgaatcttggtttggcgtgcttgtaatttcaagtttgccgttgtttacaacaagccaagcccagcctgaaccgaaacggccggcagctgctgcggcgaatttttctttaaattgatcgaagcttccgaacgtgtttttgatctcttcagcaagctcaccagtcggttcgcctccgccgttcggagataaaagagtccagaataaagagtggttggcatgtccgccgccattgttgcggacagctgtgcggatgtcctccggcactgcgttcaaatcagcaacaagctcatctacagatttctctgcaagcgctgatccttcgatcgctttgttgaggtttgtcacgtatgtgttatggtgcttcgtatgatgaatcgtcatcgtttccttatcgatatgaggttctaaagcatcataagcgtaaggcaattctggaagtttgtaagccataatttttttcctcctttaaatatatgtactgaaatgccgcttaacgcgaacttttctaatctcaatgtaacaaaagaaagcatggtaatcaatgaaaaagctcacaatccggcgattccagcagacatattacactttatccgttccctgccgaaattaaacctttctaaagcaccgtccataagaaatatccgatcataaagagctgaatgacgccttttgccgccacgcttgttaaaaaaccgattaacgagccgagccccacttttgccgcggacttgatatccttttgatgaacaaacacctcagcgcagacagcaccgataaacggccctaatataatgcctgccacgggaataacgaagggcccgatcaataatccgatcgtgcttccccagattgccgccctgcttcctccgtaccttttaacgccaagtaaatttgacacataatcagctgcgaataaaacggccgcaaataccgcctcaatgagccaaaacaggtaagaataaggactgaaggaaaacaaaaatccgtagagaagaaaaccggccacaataaaaataacgcttggaatcaccggatatacaagcccgataaaagcaatgatgaagaccgcaatgataatcagccaatacaaaacactcatgacaaaaacaccctcctttgttttgcgggcgatcaccgcttcccgctttatcttattatgtatgattccttatcaccgctttaaatactctcacttgtgttcatcccctgtgaacgatacaataagcaacatataccagtttaggctaggaagtgaagatgttgaacatatttacggctttattgaaaagtacatactctccggcagatattgcaaaaacacggtttcaggggataggaaaagcgatcctttatgtatttttgctgtctgtcctttttacgctgccaagcgcttattacctttgctccggcaccgtaaactcaatgaacggtttcaaaaccgtgttaaagaaagatttccctgatttcagcatttcaaacggagaattgcagacgaaagcgtccgcctctaaggaaacggaagcgaacgggttcgtcatcgtctttgatcccacagatgcttacggcgcgaaacaaatagcggcgaaacaaaatgcgatcggcattttgaaaaataaaatggtgcttgctgtagacggacaagcgacagaaatgaattattcgctgatgcctgccgatatcacaaaaaaagaaatcatatcagcattaaaccaaaataaaacaatgatcgtcaccgtcctgtccgttttgctgttcatcatgacagcggcaggcaaattcattgaagtatcatttctcgccgtcatcggcctgatattgaaaaatgcgcaaagaaagacattgaattaccagcagctctggaagctttcggcttattccattacactttcgaccgtattctttacgatcatgcgcgcgcttgttattacggtgccgagtgaatttttagtgaattggtttgtaaactttatcatccttttcctcgtcttaaaagagataccgcgaagtaaaacagatgtataacaaagactgcccccggcggtcttcttttttgtcatgaacaaaatgggacaagcatacaatgaagtaaaaatgtatgcgggaggcggttggaatgaagcggcttacttttgtattcggcagtttatttgtgatattcattatcttttacgatcttaaaatcggcacgatcccttctcaagaccttccagcatacgcagcggcggcacagccagcccaacaggaagcttcatacagaacggttacggtcaaaaaaggcgatacggtgatgtcgatagtcggcgcacataaagcgccagatgatattgcacaagattttgaagcgctgaatccgaatgtaaaagcaaacgccattcaggcaggcaccgcttataaattccccgtctaccgcaattaaacgttaatttcttgtcagttcggcaaatacactgttacaatataacatgtaaatagaagttgcctgacatgtaaaaggctcagcctgcaaaagcggtaactacaattaaggagcgattgacaagtgagtgaaatcacacatcgtacaaaaacgcgtcccgtcaaagtgggacctttaacaataggcggaaataacgaagtcgtcattcagagtatgacgacgaccaaaacacacgacgtagaagcaacagttgcggaaatcaaccgtttagccgaagccggctgccaaattgtccgggtggcatgtccggacgaacgcgccgctaacgcgattgccgacatcaaaaaacaaatttccatccctctcgttgtcgatattcattttgactacaagcttgcattaaaagcaattgagggcggggccgacaaaatcagaatcaatccgggaaacatcggccgtcgcgaaaaagtggaagccgtcgtaaaagcggcgaaagaaaaaggaattccgatccggatcggcgtaaacgcgggatctttggaaaagcgcattttagaaaaatacggctatccgactgctgacggaatggttgagagtgcgcttcatcatatcaaaatcctggaagaccttgactttcatgacatcatcgtcagtatgaaagcgtctgacgtcaatctcgccatagaagcatacgaaaaagcgtcaaaagcatttgattatccgcttcacctcggaattacagaatcgggcacgctgtttgccggaacggtaaaaagcgcggccggactcggagcgattttaagcaaaggaatcggtaacacgctccggatctctctgagcgccgatcctgttgaagaagtaaaagtagccagagaactgctgaaatcattcggtcttgcttcaaacgcggctacgcttatttcatgcccgacatgcggacggatcgaaattgatctcatcagcatcgcaaatgaagtggaagaatacatttctaaagtcaaagcgccgattaaagtagcggttctcggatgtgccgttaacggaccgggcgaagcaagagaagctgatatcgggattgccggcgcacgcggcgaaggacttcttttccgcaaaggccaaatcgtccgcaaagtccctgaagaaacaatggtcgaagagctcaaaaaagaaatcgacaagctggcagaagaacactatgcaaagcttgaagcagaaaaagcaaaagcagaacaagaaacacaaaaagcttgacggatattccgccaagctttttttttgcgttgtgttaaaaaaacggtgtaatgaagatgccaagcacaagggaaacaataccgattcccatcgcccatccgcctaaagcgcctgctcctcttcttctggcgatatagccgacgataatgccgcatgcccctaataaaacagggagcacaaacagggaaatgatagaaatagccaatgctgcataccctatcccccggccttcacttactccgtcccgattatcatcacggtctgctgcccggtcagaagcacgatatggctctgagatttcggccgctgtttcttctgaataaacatcacgcgtgatatcggttccttccgatccatgatccacgtaatagtcgttgccttttcgattttcgtaatcgtatgccaccttcaattccccctttttcttttatgaaaggagcttttttagtttccgcgttttttacggattcatgtttgctaaacttttctggtattgttaattgtttatgttacacttgaagggatgaatttataggagtgtggacatgttacggttaggtatagatattgacggcacagttacggcacaggatacatttgtcccttatttaaaccgctcatttcatctttccattaccttggatgatatgactgattatgatctgacgaagcttttgaacattacagacgaggaattttgggaatggatgaacgttcatgaagcagccatatataaagaagcgaagctcgcggaatttgccaagcaggcactggacggactgaaagaagagcaccgtcttatctacattacggcaagacgcggccacttagaagatgttacgctggactggtttgcaaaccgggacattcattacgatcacattgagcttgtcggaggccatcacaaagtggaagccgtcaaaaaacacggcattgatttatttttcgaagatcaccacggcaacgcgacaatgatcgcaaaagaagcaggcattccggttatcctttttaactccccatataatcagctccccatcgattccaatattatcagggtgcataattggcttgaagccgtcgcctggattaataaaaacaaacacagctttcagcatgttaaaagctgaaaaaaacctcctgtatatagcaggaggttttttatcggcacgccggacaggtgccgtaaatttcaaacttatggccgctgatttcatacccttccaaatcatcgtgcagcttatccatcggacaggactcaatttccttcgttttcccgcaggttaaacagataaaatggtgatgatgatgggtataagagcatgtaaaacggaacagtttttctccggaaagctccgtcgtttccaaaatgccgagttcttcatataacgaaagatttcggtatatggtatcaaaactcagacccggatagtcgtcatttaatgcggcaagcacgtttttggcggtcagatatttatcagaatcagcaaaaagctgcagcatgtcttctcgcttactcgtatatttataccctttttctttcagcaggttcaacgcttcttgtacgttcatgaggacctcccctttacaacacggtatcgctccaaaaagaaaatggcagctgtctgaacagcaggccattttcttatgatgtatcaaattatacctataaaatgatgaaaagtaaatgaaagcctagtgaatcgcggttttgaacttaccgcccctcgtttcatgggtattcatgatcgtaataaaggcgtttttatcaatttcaaacacaatggatttcaatttagtcacttcaagccttgtcacgaccgcgtaaatgacttctttggattcatccgtatatccgccttttccctgaagcttggtggttccccttccaagccgatgcaagattgcgtctgaaatttccgcatactgatctgccacaataatgaccgcttttgtttcatcaagcccctggatgacggcgtcaatcgttttcatggcaatataataagtcatgaaagaatacatcgcctgctccggaccgaacacaaaaccggcccaaataaaaataaacacattgatgagcataacgaattctccgactgagaagggcagcttttttgtgagaaggataccgagtatttcagtaccgtccatcgagcctccgtttcggatgacaaggcctaccccgaaaccgagcaaaagcccgccgaataccgtcgccaaaataggctgggtcgtaatggcctccacatggtgcaaggaggattcaatcagcgctaaaccgacaattccgataacagtagagatgagaaatgtttttccgatatatttatatccgaaaatcataaatggaatgttgagtaacacaacgaataaggcgaaattgaggaggggattggacataaagaggtggtctaaaattaatgaaacaccgataatgcctccgtcgataaaattattagggaccagaaacaattcaatacttacagcggctgaacccgccccgatcagaatcataatgaccctgaagataaagtgtaaaaatgactctcttttatgctgtttatttggggtcataaaatctcctttcctgtaataactattttaaacagtaagcaacttcattttaccattaaaagccgtaacattttaatgatttgctcaatacattatgtctaaagaggtgaaagtatcgatgattttaatacaaagaattattttgcagcggctcaatcaagtcactgcggacgatcttctgaaatattccaagcaatacggaatcagcattacgagaagtcaagcggctgaggtagcggctctgatgcacggaaaaaacatcaatatttttgatgaacaggagcggcttcgcctgctgaaaaaagtagaaacgataacctcaaaagaaacagctcggaaagttgacgaacttttcaaccaattctcagggtaaaaaaggagggggcaattccccctccttttttattgagctgatattttttcaagaagctcctgatcaaactgcttttctttcagcatttcgatttcaaaacggtacggcggcttcttatttttcttgtcttcgcctacatacggtgtttcgaggattttcggaatatcggcaagctgctcgtgatgaacgatgtactgcagagcgtcaaaaccgatctctccgaacccgatattttcatggcggtctttccgggcgcctttaatatttttactgtcattcacatgaaggacttttatccgatcgatgccgacgattttatcaaactcgttaagaacaccgtcaaaatcattggcgacatcatacccggcgtcatgggtgtggcaagtgtcaaagcagacggatagatgttcattatgcgtaacccccgcaatgatctcggccagctcttcaaagcttcttccgcattctgatcctttgcccgccattgtttccagcgcaatctgcacgttttgaccgggaacaatcacttcgtttaaaccttcaatgatttttttgatgcccgtctcagccccggctccgacatgcgctcccggatgaagcacgatctgtttcgcgccgattgctgccgttctttcaatttcagaacgcagaaaatcaacacccagctcaaacgttgccggatttgtagtatttccgatgttaatgatgtacggcgcatgcacgacaatctcatcgatgccgttttccttcatatgggcgcggcccgcttcgatattcaagtcttcaatttttttgcggcgcgtgttttggggagcgcccgtatagatcataaatgtattcgccccgtacgaaacagcttccttgcttgcggcaaggagcatatgttttccgctcattgagacgtgtgaacctattttcagcaacccgagtcccctactttcctttgttagatttgtttcttctctgctttctttttatcttttccatttcgtagctcattttctttttatagcccggcttcacttttttcggttttttcacgaggcgcttcgccatttggtcggcctcattctccgattttttgcgttttttgcggcggtggcggtcatcgcctttcttccattcgccgtttacaagctccgcatagtcaaacacaatacccatcttttcgagtcttacgagcgcatcttcgtcagaaagctcataaatggtcagtgcttggcctgatgaaccggcgcgtgcggttctcccgacgcggtgaacataaaaatccagatcgtccggaagctcatagttgatgacatggcttacgcctttaatgtcaattcctcttgccgcaaggtctgtcgcaatgacataagtgaattccagatcattaatctgcttcattaccttcttacgctcacgcggcgttaatcccccatgcagaagaccgatcctcatgcccttttcagtcaggtatttcgcaatatggtcagccgtgtttttcgtattggcaaacacaatgcccagataaggattcagatgagacatcatatcaaaaagcagcttgtctttatcacgctgtttagaaggaaccaaaacatgttcaatcttttcggctgtgattcttttcggctcaacatgcgcgtacttcggattttccatatactttttcaaaaacggcttcagcttttccggaatcgtagctgagaacacaagcatctgaagttcttccggcatccgcgatccgatataatcaacatcttctaaaaagcccatgtcaagcatcagatctgcttcgtcaatgacgagagactgcgctttatagacgttcaatgcctgcgccttaatcagatccgcgatccggcccggcgttccgacgacgagatgaggctgtgttttcagcttatcaattgatttttgcttgtccgtccctccgatgaaacattttgtccggatcggctcatcttccgcaccctgtgtgattttgagcgcttcctgatgaatctgattggcaagctctctcgtcggcgccgtgataacagcctgcaccgtatcagaacccggatcaatccgattcaaaattggcaataaataggcgtgggttttccccgtccccgtctgggactgcccgatcacgctttcgtttttcagcacggcgggtatcagccgcttttgaatatctgtcggttcataaaaaccaaggcggtgaactgcatctataataaacggttttaagttgtatccatcaaatttagtttctttcatttttcccagctccttaaagcggcacattctgtgtccatcatcacattataaccgattttacttaaaaacaccatgtcttgggggaatcctgttttcgagacagaaaagcaaatgccccctccgatgcatattgtaatagcagagagacagaaaggaggtacaagtatgtttccacagcagccgatgagaaatatggcgcagcagggccggccgttgatgaatccgcgtatgatgatgggaggaagaccgtcattgccgggccggcagctgatgcagcagggccggcagcttttccctcagcagcagattgccggagcgggcctgagaaacgcaggcacgggcggcggagggggcttaaaagggatgctttcccgttttttacccggttcaggaggaggaagcgctgccgcgtcggcaccggcggcggccagcggaggagcaggtgcaggactgcagggaatacagaacctggcaagtccggcatccctgtcgagcatgctcggcaacgttcagaaggtgctcggcgtggcgcagcaggttacaccgatgattcagcagtacggtcctttagtacggagtctgcccgccatgatgaagctttacagccaattaagcagcagcgatgatgagaatgaatctgacgagacaaaagaaacaaacgaacaggataaaaaggatgaagctgaaaaaacagatgaaacagaagatgaaaacaaatcagacgcctcatccaacacatcaaagaagacgtctgaaaaagcatccgcttcaaaagaaaaagacgccgcacaggcagactcagcggaacagccgcgtccaaaaagaacatcgggcagatcaaagccgaaattatatatttaacattctttgatatctcacgaaagattagctataatgagatcagaagaatgcaagatttgagccgtttaactacggctttttatattgcctctacactcacttttgataggaggacatctacattggacgttatcaaaatatcgccgcgcggctactgttacggcgttgttgatgccatggtcatagccaaaaacgcgtcactcgataaaacactgccaagacctatatatatactcggaatgattgttcataataagcatgtcacagatgcgtttgaggaagacggcatttacacgcttgacggcacaaaccgtctggagattttaaagcaggtggaaaaaggaaccgttattttcacggctcacggggtatctccggaagtaagaaaagccgctgaggaaaaagggcttgttacgattgatgccacatgcccggacgtcacgaaaacacatgacttaatccgaaaagtaaaagctgaaggctatcatgtcatatacatcggcaaaaaaggccaccccgagcctgaaggagccgtcggcgtcgctcctgaaatcgttcatctcgttgaaacagaagaagacgtcagaaatctcgatattcaggctgagaaattaatcgttacaaaccaaacgacaatgtcccagtgggacgtccacgatattatggaatcagtcaaagaaaagtacccgcacgtggaataccatcaggaaatctgcctggccacacaggttcgtcaagaagctgtatcagagcaggcaaaaaaagcggacttaaccattgttgtcggcgatccgaaaagcaataactccaacaggctggctcaagtgtcagaagaaatcgccggaacaaaagcctaccgaatcggagacatcagtgaactgaagctcgaatggctgaaagacgtcaataccgtcgccgttaccgcaggcgcatcaacaccgacaccgattacaaaggaagtcatccgctttttagagcagtttgaccacaacgatgaatcgacatggcagcttgaacacagtgtgccgctcaaaaaaattcttccgaaagtaaaaataaaaaactgaggcccggggcctcagtttttttataagaaggtaaatgggtttgtatctgtttcggaagcgaaaatgcgcacgtcatagtttttctctccggccattgccgtaagcttctcagccgtgccttttctcatgatcttttcagcataatgccccgggtccacgacgtttaatcccatcatcatcgcatcatgcgctacatgaaaataaaggtcgcccgtcacgtaaacatctgcacctttccgctttgcctgataaatatatttatttccgtcgccgccaagaaccgcgacctttttcaccttgctgtttcgctctccgaccatccggactccgttaacgtcaaacttttctttcacaaacagagcaaactcttcaagcgtcatgtcctgctgaagttttccgatccggccgaggcctttttcaagcggagactgctccaccggataaatatcatatgccacctcttcatacggatggctttttttcagcgcttttacgacggttttctccatacttgccggaaaaacggtctcaagtctcacttcatggacgagttccagctctcccgtctgtccgataaacgggtctgccccgtccagcggcttaaagctcccgattccctcagaagagaacgcgcaatggctgtaattgccgatatgtcccgctccggcgttgccgagtgcggttcttacagcttcttcatagtctttcggaacatatacggcaagttttttcatcgggtccgaatatgtcgggacgagcacttcagtgtctgtcaggccgagagcttcggcaagcagatcgttaacaccgccgtccgctacatcaagattcgtatgagccgcatatacggcaatatcatgctttatacatttctcaatcagtcttccgcccggctgatcagtggtgatctgtttaagcggccgaaaaatcggcggatggtgggcgataattaagtcaacttttttctcaatggcttcatctaccgtttgttccaaaacatccagtgtcaccatgacatttttcaccggcttattcaatgtaccgatctgcagtccgattttatctccttccaccgcataagccttcggtgaaaattgttcaaacagctggatgatttcctgtccgttcacatgtttaggcatgtccgattacctccttcagcagagaaatccgctctttcaattcagctaatttttcatgattttcatgctttgcgctgcggctgatctgttcataaatttgttcagtatgcttaagttcctggctccatttccgaagaaacacttcattcctctcttttaacaaaaacggacccgcaagcattccgacagccatcggcacatcccgataaggcgcatcacggtcgccagtttccgcaacgaggatttcataacactttccgtcttcttcgagaatcacttcatcaagcagttcatagccttcctgatacagccactctcttatatgaacggcatgaatattcggctgcagaatcagccgttcacgccctgtcaatttcgtttttcccgactccaaaatatgagcgatcagcgctccgcccatgccagcgatcgtaatggcgccggcttctcctttttcaaggacgctcagcccgtcacctttccttacggagataagagtgcttaagtgcagtttttccacctgctgtttggcggatagaaacggtccgtctgtaatttcaccggcgattgcccggcttgccaaatgattcaaaacggcatagcaaggaagatacgcgtggtctgacccgatatcagcaaccagggcacccggagggatatattccgccacagactgcaatcttttcgataacttcatttcattcacaatatcacaacttttctcaggttctttttcctttactatcatataaaaaaaccgcccggaatccaagcggcggatagagtttttcatatgtcttttatatagggaccggtaaagctttatttaatgtcagaaacccattttgccatgtcatccagcttttcggccggcacaaggcccgcgggcatcccgttgccgcctttttcaatttttgttttaatctcagcgacatcttttcttttgccgacgccttttaagttcggccctgacacaccttcatagttttctccgtgacaggtgatgcagttggctttataaatctcttcaggtgaagcgtttgcagtttccttctcggcatttttgctttcaccgccgcttgcgatctgatgcgcatctccattgccttttacagctaaaaagaaagtcagccctattcccagcactgcaatgagcaaaaaaggaatcagcggattccacttcatatctccatccccctttttcattctccccctatgtaaacacttctaattctaacttatttttacaaaaagtaaatggtcttgctcagcaatttcaatgatttcacaatttatacaaaaagcaaaaataactgttttgcttaccacaaaattatctttattctattgtataatgaattgtatacgcttacaataaagaatataaataaacttgtctcatttcccccctttcaggacatgccgcattttttccaaactcatttgcaaaacatatgcttatccagtaaaataaaggtatattatccatatatcttatacataaaaaagaacggatcaaaaagacccgttccattctattcgagaaaatccttcagacgcttgcttctgctcggatgtctcaatttgcgaagcgcttttgcttcaatttggcgaatacgctctctcgttactccaaacactttgccgacttcttccaaagttcttgtgcgtccgtcatccagaccgaaacggagacgcagcacgttttcttcacgatctgtcaacgtatccagcacatcttccagctgttcttttaaaagctcatatgccgcatgatccgacggagatgtcgcttcctggtcttcgataaaatcaccgagatgtgagtcgtcttcttcaccgatcggtgtttctaaagaaactggctcttgagcaatttttaatatttcacggactttttcaggcgtaagatccatgtcttcagcaatctcttccggtgtcggctctctgccaagatcctgaagaagctgacgctgcacccggattaatttattaatggtttccaccatgtgaaccgggatacggattgttctcgcctggtcagcgatggcgcgtgtaatcgcctgtctgatccaccaagtcgcatacgtactgaatttatatcctttacggtagtcaaacttctcgacggctttcatgagacccatgtttccttcttggatcaagtctaagaaaagcatgccgcggccgacataccgtttagcaatgctgacaactaaacgaaggtttgcttcagccagtctgcgtttagattcctcgtcaccctcttcaattttttgagcgtaggtgatttcttctttagcagaaagaagatttacccgtccgatttccttaaggtacatgcggactggatcattgatctttacgccaggcggtacgctgaggtcattaaggtcaaattcttcttcggctttggcaagctgttgaatattaggatcttccgtttcttcattttcactaattaattcaacaccttgttctcctaaaaattcataatactcatccatttggtctgattcaatttcaaagctggacatgcgttcagcaatttcttcatatgttaaaacgccacgtttttttccagtttcagtaagctgctcttttacctggtctaatgtaagttctgtttctgtttcgtgggtttgtttatcagccattatggatccctccttccaaagcttgcaacgaattctaaaagcggtatgtttcttatccgacccggaagccttctctctttttcagcatgcagggctgcggataataatgacaattcatgatgaggttaagcgatctatttgctcctccgcaaggaatcattgccaatcagaacgcaagcctctatttgttgttactttaatgatcggttcaatgcaacaatttcttgagccagagacgcagctttcacgaagtctttctgcctctccgcatccgctctttctgcttctttttcctttatcattgaccattttcggtgatccaacactttttttacgtaatcggataactcggcctctgagagctcctcgtttacttggagcatccctatatctgaaagcagctggctgatttcctcatcctgcattctcgccataagatgctgcggcgtcatgtcagcaccctcttcataaacagcgtacaggtatgctgccagcgcacgatgtccgtcaatgttaaattcaaagccgacacgctcaatcactttcttgatgacgtttcggtctctcagcatatgagcgagcagaagtctttccgcgttctcataggcgggacggagacggcgccgtttcgctttagtcgtcacccgggcccgtcttgtctgcggttcggcgtttttgtcgccgggggcgttttgtctggcgtagatggaaagctgttccgtcaaagattctaccgaaagagaaaattctgaggcgagctgcttcacatacatttcctgctcaagcgacccggaaagagcgctgatttctttcagcacttctttcatataagcgagccggtctccttcgtcagataagtttttccctttgcggaaatattgcattttaaaagccatgaccgtaacgcttgcatcaatgatatcggtccggaatttttctccgccccgggttctgatataatcatcaggatcaagcccgtcaggcagcatgcttactcttaccttacaatcggctttctggagcaggccggccgctttcagcgtagcttcgtacccggctttatccgaatcgtagcagagaatgacctcctgaacatttcttctgaggattttcacatgctcttcggtgagcgacgtccccattgtggcgatactttcttttacgcctgagctgacggcggatatgacgtcagcgaagccttcaaacagaacggctctctcctctttcctgatcggcaggcgcgccttatgaaagttatacagcagcttagatttatgaaacagcggcgtttccgggctgttcatatacttcggctgctggcttccgagcgcccttcctgaaaaagccgccacggctccgtggtgatcatgaatgggaaacataattctgtttctgaaacggtcaaaatacccgctgccgtcttctcttctgatcagcagacccgctttttccatcatttcttcctcaaaaccgcgctttttcaagaatttcgtcatgaaatcccaggaatccagcgcgtagccgatttcaaactcatctatgagctctttcgtaaaaccccttgataaaaggtaatctaacgcttcctggccttcctttgtatttattagcaaatgatggtaaaatttcttcagaagctcgtgggcttcctccatcttctgctctccggaagattcaggcctggatgcagagtgaatcgttatatcatcagggaaatcaatctgatatttatccgcaaggtgagaaacagcttccgtaaatgaatagccttccatctgccgtaagaaagagaaaacgttcccgcccgctccgcatccgaagcaatgaaagatctgcttatcgctggagacggaaaacgagggcgtgttttccccgtgaaacggacagagcccaaagtagttgcggccttgctttttcaattggacataatcacctatgacttcaacaatgtctgctgactgctgcacctgattaactacttcatctggtatgcggtttcccatcttataacactccgtcgtacattattcgatgttttgatttgaaatcccttcatcattcgacaggatttttttaagcagggtaacaaatcgattccgatcttctttatttaattttttaggtcctttggaatgaatgccgcttcttctcattttgcctgacatatgacggctcatcagagcgaagtcaatcgtgtcttcagtataagaacggcccctttccgataagacggcaatatttctgttcagcaaaagagatgctaaaccgatatcctgcgtgactacgacgtctcccgatctcacatggtttgcgatatataaatctgccgcttctttatgaggatcaacgtatacccagttctcgtctttgcttctggaaagctggtagtgttcaaatgatgcgacgaaaataacccgaacgctgaattgcgatgcaatgagcattatttcctcttttacggggcatgcgtctgcatcgacaaaaatcgtcttttctttttcatttagaagactaattctccatccctccatcaatctcctgcataaaaacaagcgaaatcgcatatgctccatgactgcggatctattttgagctttgtcgaaaaatttccgggagttattcttgacatcttacccataatagtttattcgtatcacacgaagcttaaacctaaaaataaacattttatcacaattttttattataatacaaacttcgcgaagatgccatcctttttgtttattccctatttgcatacccaaaaacccaggataaagcgtcctgagttatcggccctttgttttgagatgatgaatgatgttcgctgtttcttcgactgctttattcgaaacgtcaacgacttggcagccgatccggtccacgattttctcaaaatactccagctcttctttaattctgttgatattggcgtaaatggctttgtcatttaagccgagagattttaaccgttctttacgtatatggttcagtttatcagggctgatttttaagccgatgcattttttcggatcaacgctgaacagttcttccggcgggtcgacctcaggaacgatcggcacattggccactttcagacgcttatgggcaagatattgtgataatggggttttagacgttctggatactccgagcaggatgatatcggcttttaaaatgcctcttggatccctgccatcgtcatatttgacggcaaactcgatcgcctcgacctttttgaaataatcttcatcaagctgccggacgcggcccggttcatatttggcggtcaaaccgtaagccgattccattttatcgatgagcggaccgataatatcgtaatacagcacattcgctttttccgcttgttcaaccaggtatttgcgcatttcaggaacaacgagcgtaaaacaaataatgccgccgtccgctttggcgagagacacgacttcattaatggtgccgatatcttccacataaggtattcttctgatatgcgtatcatcggctgagccgttaaactggctgagcgaggcttttacaacgagttcggcggtttctccgactgagtctgatactacataaatgatgcgattgtccatgttatccccccgttagttttcaagcttatatgatttcattttctgataaactgacaagtatcttagtcatattcgttttggtaaaccggccgatgacctcaaagcctttatccgtatctttaataacgggcagggcatcgatctgtttttcaattaaatacttggcgatgtccatcacataatcatcacgccggcagacggcgatattcggcattcttgtcatgataatatgaaccggtattgaggcaagttcctgctggccgatgctcgcccgcagcaaatctttgcgtgacagcacaccgactaagacagcatcacgatctacgacaaataacgtgccgacatcttctaaaaacatggtgcagatggcatcgtataccgagacattttcattgatgacaacagggatcgattgaaaatctttcacttgcagctttttcaatttatccgcaagcagctgatttcccgttttccccgtataaaaataaccgacccgcggacgggcctctaagaagcctgacatggtgagtatggccaagtccggccgcagcgtggccctcgttaaattgagctgttctgcgatatgctctccggtaatcgggccgttttcctttacaatctgtaaaatttgttcttgccgtttatttaattcgatcgtactcaccacctttatggaagggtttctttatctatgttttcattctgtgatgtttatgtaaaaggggaaaagacgattgccgatcacacagcaaccgtctttttctttattttacaataagatgattcatattagcaaaagacttgatcacatctgcaagagcggtcatttgcgctaaacggttggtttttaatgcttcatcgtccgcatttaccatcgtgtgattaaagtaatcttcgatcggctcttttaatccgctgagcacggcaagcgcctgttcatagtttttggaggcaaagctttccgcgacactgtcttttgttttttcataagcgtcaaacagctttttctcctgttcattttcaaacagatccggcttgatatcgcggctctcgccttttttactgatggagataacccggccgagtgattcagccgtttctttaaagccgggtgtgccgaggtgcttctcaagcactcttgccttatgaacggctgcatacggctcaagctctgtgctgtccagaacggcatcaataacgtcatgacggatgtcttcagcgtttaatacgtatttcagacgctgtgtaaagaaatcaaggagctcattctctttttccgtttctgtcaacgacagcagttctttaaaagaaatgccccagttgcggtcgatcagaatggaaacaatgccgcttgcctgacggcgcaatccgtacggatcctgagaacctgtcggaattacgtcaatgctgaagaaggaagcaatcgtgtccagtttatcagctaacgccacgaccgcgccgataaaggttgaaggcacttctcccccggccgctctcggcatatagtgctcattgacagcggcagcgacggcatcatcttcaccgagcatgcgcgcatatttttctcccatcacgccttgaagctcagggaactcatagatcatatgtgtaaccaggtcaaatttagaaatctctgcggcgcgcttcacaagtttttgcgtctgttcatccgctttcaggcggacggcaagtttgcccgcaatggtgaccgctcttcttactttatctccaagggagccgagctcttcatggaaaacgatattttccaatttcttcacgttttcatcaatgttcagcttttggtcttctttgtagaagaacgcagcatctgaaagccttgctctcagcactttctcgtttccgcgggcaacattttcaattgcatggctgttcccgtttcgcaccgtaataaaatgaggaagcaaattcccgttttcatcttttaccgggaagtagcgctgatgctctttcattgttgtcacaagcacttcttcagggatagaaagaaactcggattcaaaagatccgtaaagcgccgtcggatattccaccagatggttgacttcgttcagcagatcctcatcgaccggaatgttccatttcttcttggccgcaagcgcatccagctggctttggatcatttgtttgcgttctttcgggtcagcaatgacgctttgttctttcagcagcttttcgtatgatgacggcgcatcaacagatacttcttggccgagaaagcggtgtccctgcgtgttccggcccgtcttgacatttgtgatttcaaacggaatgacgtcttttccaaagagggcggcaatccatttgatcggacggatatagcgcagatcctgcgtgccccagcgcatgtttttcggaaaatgcattccggcaatcaaattttccagttgcggtaaaagtgtcttcgtctcttgtcccgcctggaatttttgaacgaagacatattccgtgccgtttacatcttttatatacaggtcatccactccggcgccttggccttttgaaaatccgatagcggcttttgtccagtttccgtcagcatccagagcgatttttttcgcagggccttttgcttcttcctgaatatcagcctgtttttctgctacgtcttttatatatactgccagacgtctcggcgtattaaaaagtttcacttcgccgtgggcgatatttttttcagcaagccagccggtcagcttttcaccgagctgcaccatgctgtcatgtaaaaaccgcgccggcatttcctcgagtccgatctctaaaagcaagtcttgtttactcatgggaagagccctcctctttaagcattgggaaccctaatttttcccgttcttcataatacgtttttgccacttttctcgctaagttgcggacacggccgatataacccgtccgctctgtcaccgagatcgcgccttttgcatcaagcagattaaatgtgtgagagcatttcagcacataatcataggccggatgcacaagcccgttatccatttgtctgatcgcttctttttcataggtgctgaacaaatggaaaagcatatccacgtcagatgtttcaaaagtataaacggaatgctcatattcagccatcataaataaatctttcacagtaaatcctgacgtccattcaagatcaaagacgttttctttatcctgaatatatgacgcgagacgttcaataccatatgtgatctcaacggacaccggcttacattcaattccgcccacctgctggaaatatgtaaactgagtaatttccatcccgtcaagccatacttcccagccgagacctgcacagcctaaagacgggttttcccagttgtcttctacgaaacggatatcatgttcaagcgggtcaatgccgagcgcacgcaatgaatcaaggtaaagctcttgaatgttatcaggcgacggcttaataatgacttggaattggtgatgctgatagagcctgttcgggttttcaccgtaccgtccgtccgcaggccgtctggacggctcaacgtaagccactctccacggctccggcccgatgcttcgtaaaaatgtatacgggctcattgtgcctgcgcctttctccacatcatacgactgcatgagcacacagccttcattcgaccagtgcttctgcaaggttaaaatcatatcttgaatgttcatttcaagcacctccactttctccattcttttacaagtgcggcggcaaccaaaaaactcccgtctctatgcttgccggccgcaaacatagggacgagagttctcccgcggttccaccctagttgctgaggatgtgaatcactcagcctctttttaaagggttgctcgagaatgcctttcgttgcgcgctcatccttagcttacactgtcctaaggtcgcttgtatgagttggacgcaagtacttctttctgtcactgcaacatattttataataaatgatcatataaaaagatgggcagaatgtcaacttttgttttcatccaaaaggttcttcatgctttccatctggtctaaaaaccgttttgactttaaataaagtcctgaatattcctcgtaatacagatcaatgacctgtttaatttcgtttttggtttcctgttttaacgagacgctgccgagccttccgatatcaaagtaataaaaaagccttagcagccttgccgtttgcggcgaaatcggaactctgtacggatccttttcaaagcagcggtggcagataaaaccgttatctcttatcgaaaaatgaaacgtcccttccccgcttttgcagtggacacaatgattcagctccggatacagccccatgacgccgagcattttcatctgcacgatgaatgtgatcacgtccgggtcagtcccgtcattcagcctcttaaaggattcgagaatcaattcgaataaataggggttcggtttcttctcttccgttcctttgtcagtgagttcagcgataaaagcggcatacgccgtcaaaaataaatcttctctgatcgttctcatgctgagaatcatttcaccctgctggagcgtgccgagtccggatgttctttgcattaaaaatgacccgtacaaaaacggctggctgactgctgacagccggctggctgacttcctggcgccccttgccatgacgccgattttgccgtgttccctcgtcagcaatgtcacgattttattcgtctccccgtagtcattcgtacggagcacgattccttcacatttagtcagcatttccgcaccttccaacaacgggaggggccaagaggtttacaaaattggaaaatcaattcgggctagctcatcttccggttcttcgggtctttccaggttctctttttccagttctttaaaaagaaggtacgtatcaacacttcctgtttgagaaaatacgttccaggtaaaattcaacacaaaaaacccacctttcatcattaaactagcttgccaatccaaattcttacccttatcttgacctgatgtcctccttttcatgttaaacaaattttgctaacgaagccctgtttctgtgaggtaatcccacacatcaggcatgcgctttagatgaattaatattcatcctctttgaagccgaaatcacgcagctgagacattttattccgccagtccttctgcactttcacccataattcgaggtaaacgcgtgaacccagcagcgcttcaatatcagcccgcgctcttttgccgacttctttcagaagcgctccttttttcccgatgacgatgcctttttgagaatcccgctcaactacaatggtggcggcgacatggacggagccgttttcctgccctttaatggactcgatagcgacagcgatgctgtgcggcacttcttcccttgtcagatggagcaccttttccctgatcagttcagaaataatgaaccgctcgggatggtcagtcacctgatcgctcggatagaattgaggcccttccggtaaatacgcttcaacctgcgcgagaagggtttcgacgttgttcccttccaaagctgagatcggcacgatttctttaaacggatagcgcgcacggtactcatcaattaaaagaagcagctggtcagggtggatcttatcaattttgtttacgatcagaaagaccggcgtggacgtctgtccgagcttttcaatgataaactcgtcgccctttccgtacccttcttcggcgttgatcataaataacaccaagtcaacttctttcagcgtattctgcgccactttcatcataaagtcgccaagcttgtgcttcggtttgtgaatgcccggtgtatcaataaaaatagtctgcgacgtgccggttgtcagcaccccttggactttatttcttgtcgtctggggtttgtcgctcatgatggcgatcttttgaccgatgaccctgtttaaaaaggtagactttcctacgttcggtcttccgatgatagatacaaatcctgatttaaagctttcgttcgtcatgtaaatcctccgatgaaaatgcgcccggcaataattcttccgcagtcatttcttttatttgtccttgtaagttggtcagaataacaagcatatcctttgagcacagctcggaaattacttgtctgcaggctccgcacggcgaaaccggtcccggagtatccgcagccacggcgagcatcgcaaattccgtatccccctcggaaacagctttgaatatcgccgtgcgttcagcacagttgcacatgctgtatgccgcattttcaatgttgcagcctctgtacacttttccgtctttggtaagaagagcggctcccactctgaaatttgaatacggcacatacgctgtgtcccgtgcttttaatgcttctgcaatcaattcttgtctgttcatgtgtacttaattcctctcttacctttatcctgtatgataccgctgtcacttttattttacataattatgatcggtttttcacgcccatttttggcaatgtaaaataattgtaagaatcttctgctaacatatcttcggcaggaagatgagtaaaccaatgatacacgatatcacggcaaagacgcaaacggctccggcggccgcgtcctttgccgcttttgcgagcgggtgatactgatcagtaactaaatccacaacatgctctatcgccgtatttaaaagctccaaagcaagcatccctccgatcagcaccaaaacaacggcccattcggctgtgctcagcccggtgagaaaaccgcaaacgataacggcgcaggccgcggtaatatgaaattgaaaattccgctctgaccgcgccgttttccagattcccctccatgcatggacaaagctcttcaggaacctgctccactcgtttttatgatctcgtgagtccatactcatccagcaaatccttttgctttgaaaacatttcttcctcttcttcttttgtcatgtgatcatagccaagcaaatgcaaaaagccgtgcacggccagaaaaccgagctctctcataaacgaatggccgtactcttccgcctgctctttcgttctgtctgcgctgatgataatatctcctaaaacaggcggcatgtcggcgcctacgatttccacctcgtcttcgccttcttcttcaagcgcaaacgaaatgacgtcagtcggagtgtcttttccccggtagtctctgttgatttctctgatttcttcatttgtcacaatcgtgaccgatacttcagcctgatcctgaacgccttctttttccgccgcgaattggagcagcttctccacttcttggagcgcatcagctgagacgctgttcgtttcatcaacaatatctatgagtaaacccatttatttcaccttcttcgtagcctccggatattcaatccgggagtggaaaattccttttaaagtcgcacatagtgttttggcgatcgtatccagttctcggaacgtgagatcacattctgagaattgtccgtcctgaagcttatcggatataattccccgcaccagtttttcgatccgctcgggattgggattatgcatggaacggacggcggcttcaacgctgtcggccactgagataatagccgcttctttcgattgcggcttcggccccgggtagcggaactctttctctgtaatctggtcgcccttttctttcgctttataataaaagaattttaaaagggacgttccgtgatgctgctccgcgatatccacaagctctttcggaaacttatagcttctgagcatattcgcaccgtctgtcgtatgtgcgataatgatatttttactgagctgaggagacagcttgtcatgcggattatccatattcatctgattttcaataaaatattgcggacgtttcgttttgccgagatcgtgataatatgctccgacccgtgctaaaagaccgtttgcccctacggcttcacaagccgcttccgacagatttgccaccatgacgctgtgatgatatgtaccgggtgtttccgttaaaatctttcgaagcaggggatgattcggattagacagttcaatcagcctcatcgttgaaagaatgccgaatcccgtctcaaaaaacggcatcagaccgataatcaaaacggatgaagcaagtcccgagacgacccccatcagcatcagcgttccgatttcaacaggtgacagcgccgtattttgtattaataaaagcgacagcacgataatcatattaataaatgagacgaacagtcccgcctgcaatatttttgatctcgcattgtgtttccccaaaaacagaatgcctgaaatgctgctgattaaatagtaaatgccgatgacgtaattaaatgttcccgtcacaccctgattaaacatcatactgccgcagatcgccagaatgatgcttcccaaaatggcgagcctttcattgagcagcagcctgattaaaatcgcgccggcggcgatcggcacaagatagccgatattggtgtattcaatcttctgaaagagactgacgacttccataatgacgagaataagcgttgtaatgatagaaaacagcaaaagagatttatttttcagcttaagctcctgctgctgtttctcaaaatagtagacaagcgtggcgataaacagcccgatcatcagaagcagaccgctgatcggctttaacaggttggaattattcaaaagccccgtcagttcaagcttcctgtatacttcccggtcgatcaggtcattctcttccacgagaacctgtccctgtttgatctgtaccggctggacgctgtctgacgcttcctggcgtttttcatccgtcgctttcggatcaaatacgtaattcggaatgaccgcgtattttccgatttcagtcgcagccgctaaatattttgacggcacagaagcgcttttcagctcttttgcgaccttatccttcgcttcggcaagcttttcagaaggaatttcactgctcatcaccgtattcaccgcggtaatgacggaatccctcacaaatgagaaatcttcattgtttgcatggagaagcgatttaatggcatcttccgagacggattcattgacatcctgtgtcagcttgtttttcaccgatttgaccaatgatttttccgaaggtgactttttgtctttttccgcatcttttttcacttcgccgatgctgtcaaaaatggaagtgatcaggtcaagccggttgtcggtatagccttttttcagggtgtattgatcttccaccgcatcttcggccgcctgttttttcgattccgtcgcctgctgatcttccactgtggcgggcgcgtaaatcgtcttatcactgactgaaaacaaatccaaattaagtgattcaggttttacatgaataaagagcaaaccaaacatgatcgctgaaagcagcaggtacagcagcacatgggctgagcgggcatgtctgaaactgcggaaccgttcccgggcgcttttgcccttttccttctttttcaaaacaagaacctcctccctgaaacatcaggaacacatcatataaaaatgacccgataacgggagatcgggtcatttttgcattacttttgcttatcataagcttcaataatttttgcaacaagcggatgcctgaccacatctgtctggtcaagttcaatcacggagatgccgtttatgtccttcagcatatccttcgctactgcaagtcccgatgtgacgcctttcggcaggtcaatttggcttacgtcgcccgtaatgatcattttagagccaaaacccaatctcgtcaaaaacattttcatttgagcgggagtggtattctgggcttcatcaagaatcacatacgcgtcgtcaagcgtccgccctctcatataggcaagcggggcgatttcaataacccctctttccataagacgctccgtatggtcgcttccgagcacatcatggagcgcgtcatacagcgggcgcagataaggatctactttttcctttaaatctccgggcagaaagccgaggctctcgccggcttccacagcgggtcttgttaaaatgatttttttaatgtggccgttttttaaagcatgcaccgcttttacgaccgccaaataagttttgccggttcccgccggcccgatgccgaacaccatgtcgtttttcttcatcgccgccacatattctctttggccgagggttttgacacggatcggtttgccttttgccgttttcgttatttcctcttcatacatgctttcaaaatagtccagttcatctttttttgccattttcacggcatacagcacatcacgttccgaaatctcgatccccttgcgaattaaagtaaggagcgagcccaataatctgtcagcgatctcaaatgtttcatcattcccggaaacgtaaatggtttcaccgcgcgtgatgaggctaatgcccagatccttctccattaaatgtaaaaaggcatcttggctgccgaacaaagaaagtgcttcgtccgggcttttcagtttgtgattaatcgcaagtaaatgttctgccattctttagtctccctgaacaataggtgtggtttgaacgatatcttctataacttggtagagaataatcaactttactttaccattctcaacggattggtgcaaaactttttcactttccacctctccgctgccgtttaatcgcttttctacatcttgtcttcccattttgataccggcctgaaccgcttcgcctttcgtataagtccgcacggttgtttcactttctcttgtctgttcttgaacgtaagaaatcggaagcttcatccccagaaattgaaacgggtgcttttcttcctctgttttcggatgtttcagcggctcctcattaaattcaaagccccaaaaaggcacgccccatgatccgaaagacagcttgtgcttcgtccttactttacccgtatatagcgtaaatgatgtttcaagaggcacggttacttctgacttgtaccatgtttctccgtaaatttccgcttttgaggcgactttccgatcttcatttccgatcagtcctgagacgagaagctgtcctttgtcaacatgatcgttcacaaaagccatcggctgccccttttgcacgaacatccttttgatgaccgccttctttttggcaacgatatggcgggggctcacgtacttttcttttgtcggttcgtttttttcgaccactttcatatgaagggctgtcccgttcaattccacaccgacccacgtaatattatcaatgccgtttgttaatgatttttgaattttctccggcgtcatcattaaaaattgcaaacgtccttttttcacaccgatttcttcaaggtgctttaccatctgatgctcggtttcgggcttggcccctttaatatcaatgtcccaaatcatgttggacaaaagaaacaatataacgaaaaacatcacaaatcccgcagtgaagcccaggtttaattttgatttgagaagcagaaagggaagaccctttctttttgtaaagcttgctttgcattcatgttttctgatgactcttctgaaagcatgtacatcttgaagctgaatcatcagcagaacacagtcttgcttttttttcaccgcaaagatggcgattccgtttctcgtgcattcattcagcaaccgttcaatcccttttcctttgacttccatttggactttacccgaaaaaaatgacagccatttgtttttcacattatttccccccggctttatgaatcgacatatcgtacgtgatctatcgtgccttccaaaagaatttcttcaggaaggattgccttaatgaccaagttttttcctgatatgatacattgcccctgcttgagcatcagcctgacttcttcttcgctgaacagcaggaggcctctgtgattctctatgtagatatgaagtctgccgaccatcgtaatccgaggcagatccatcataacgtccgggggaatttccaatgctcttgtcagccatgcctttacacgattctttctttgccccataaaaaaagaaccccctttcatctcatatgtatgatttgaaaaggggttctaacactttattttttaccgatgctccgcatggtccggtgcggtttttttgcacggggcggacccaaaacctcactgaatataatgccttgaaccgcagtttctttatttattttgagggctgatttcttcagagacgcgtttcgtgcgcgttgagatgtcagcttatgttcaagcccgttaaacatctgctccgtctccgctaggcgcttttcagcttcccttcttttttgctcaaaagggttctcttctgaaacggcaggcaattcttccgcttccggcttatgctctttctgcggctgtttttgatcctgcttttttgtctgattttcggggcgtgtacccggcggccgtttttcatctttgtttttcttgccgaatattgccgatataatgccgatgacggcggcaatgacgagcggatttgtcagaatctcgtgcatatagcggctccctccttaatagagaggttattgttggtcttcatcttgctggtcattcgtcagcttgccgatagaatccctcatgtccgtatccgcgtcgatattttttatgttcatatagtccatgacgccgatgtttccttcacgcagcgcttctgccatcgcaagcggcacttcggcttctgcttccacgacttttgcacgcatttcttctacgcgagcgcgcatttcctgctcttgggcgaccgccatggcgcggcgctcttcggctttggcctgcgcaatgtttttgtctgcttctgcttgatccgtttgaagaatcgctccgatgtttttgccgatatcaacgtcggcgatgtcaatcgaaagaatttcaaaggcggtgcctgaatccagccctttgccaagtacggtctgcgaaatcatatcagggttttcaagcacttttttatgattacccgaggaaccgattgtcgagacaatcccttctccgacacgggcgacaaccgtctcttctcccgctcctccgacaaggcgctcgatattggctcttacggtgattctggcttttgcttttacttcaattccgtccatggcgacacccgcgataaacggtgtttcaatgaccttcggattgacgctcatctgcacggcttccaatacgtcacgcccggccaggtcaatggctgcgcagcgttcaaatgtcagctcaatattggcgcgctgtgccgcaatcagggcattgaccaccctgtcaacattaccaccggccagataatggctttcgagctgatttgttgttgcggataggccggctttgtgcgctttaattaacggattgacaacgcggcttggtatgacgcgccgcagcctcattccgaccaaagtgaaaatgctgattctgactcctgccgcaagcgccgaaatccatagcatcaccggtacaaaggtgaagaatatggctaacacgattatggcagctgcaactattgctaaaatcgccaaacttgacagttccatctaattcctcctcaaggttatcatctatatttctctcacgacaatgcgtgagccttccgctttcactactttcacctgtctgtctttttcagtgaatgatccttccgagacgacatccagacgttcatcatcaataatgacggtgcctgacggtctgagggctgtagcggtaatgccgactttccccaacagctccgtccggttctgatttgaaacataaccgctctccgtgcttgttgaatcagttaatattaattttttaaagaatttcattcgtttccccaacacccttgttaatatgataaaggctgtaatagacacagcaatggcgatcaagagagaaaccgccattacggtaaagctgcccgcagcgagaaagaggctcgcgatgacgcctgcaataccgataagaccgattatgcctccgggcagaaatatctctaaaaggataaaaaccaagcccgcgcaaaataagaatacgctgtcatagccggcgaatccggcagcgatatgcccggtgaaaaacagcagcatggccgtcagtccgacggcacccggtattccgaggcccggcgagaacaattcaatggtcaaaccaagcaaagcaagcgttaataagacggggacaacaaacggatttgtcagccatctgcccaatttgccgacaaaaccttcttttgcatggtgaacatccgctttgtcaaaaccgagctttgtatataaagcatcaaggtctgaaaccgtgccctccgaatatccgacttccttggctttttcagctgtcagtgtcagcagttttccctttggggcgcccgcttcctttgcattgatggcgggatctgccatggccagggcgtatttcggatttcggttgtttttaaccgctgcgtcctccatttctgcatgccacagtgattgagcctttttgtccgccgcgtttccttttccgtcgatgatggctgcggcacccatttttccgcccggcgccatatagatttcatctgcctgaagcgctatatacgctccggcagaaagcgcccgtttattaacgtaagcggtaacaggcacatccgcgcggccgatgatatccgcaatatccaaggctgattgaacggcgcctcccggtgtattgatgtcaagaataatgtgtgacgcgccggactccttcgcttctttgaaagaacgcgataaaaacgaggcgagcccctgttcgacatttttctcaaccgggatgacataaaccgatgggtgatcagctttcgcgttcaattgaacccctaataaagataatacaaataagcccaatagagcaacagcaattccgtttttttttcggaacaaggcaaatataccctccttcccgtttcgttcttctttatatacgtaacaaatgtactttagtttcatttttttatgtataaaaaaagacatctctctaggaaagatgtcttttttcttgtcaattaagataattgactgctgacaagtctgttaattacactgccgtcagctttaccttttactttaggcataatagcactcatcactttgcccatgtccgctttggagctcgcaccgacttcagcgatggtttcatttacaattgtctgcagctcttcttcagaaagctgcttcggtaaataaatttctaaaatgtccagctctttttgaactttatctactaaatctaaacgatcagcgtttgaaaattcatggagggagtctttacgttgcttaagttcacgagataggacagtaagttcctcatcctcggtcaaactgtctttcttaagcttaattgcttcgttttgaagtgaagctttcaccattcgaacgacagtcagtttgtctttctcacggcttttcatatacagcttcatatcttggttaagtcgctcaagaagactcataaatccaccctcttttagaatttgcgttttctagcagcttctgactttttcttgcgctttacgctaggtttttcataaaattcgcgctttcttgcttcttgcaaagtacctgtctttgatacactgcgtttgaagcgacgaagagcatcttcaagcgattcgttttttctaacgaccgtttttgacattctctttccctccctccgaatacaccaatcgactacctttaaaaagatacatatataaacatgtactttgacattataatataagccatcagtcaggtcaactaagcgagctcacttttccgtcatgaataaggctgcttgtctatataatgatggaaaggggtgtttcgtttgataatactgattctctttaccgcacttatcctggtttttttactcggaatgagcctgctcaggcagggcctgatcgcattaacgtattcaaaaattgagaaaagcctgctcttatttaccgaccaccctttgaaagcttttctcataagcatcgtattcaccggttttcttcagagcagctcagccttcatggtcattgtcatcggctttgtcagcgcaggcgctttatcttttaaacggaccattccgatgattctcggcacgaatgtcggctccacgtttacgacggagtttttagccataaagatggatgtgctcatttgggtgctttttatcggaggccttgtgtttatcctcatccgtaaatatccgttcaggcagatcggtataagcttcctcggtctcggcatcatctttttttgcatcacatgcttcagccggcttgccgttccgctgacagaaatgaaggcggggcggaggttttgcgccatgtgaatgattcgagctggtccgctctttttatcggcatgatattgacggcaatcattcattcaagctccgtctgcatcggcattttgatgagttttatgaacgaaggggtgatcggcattgaacaagcggtcagcgtcgttctgggatctaatatcgggacatgcgtcacggccgtcatggctgctgtttcaggcggttatgccgccagacagaccgccggtgctcacgtagtgtttaatattctcggcgtgctgctcgtctttcccttcctgtctgcatcagcaggtattacggagcgcctgtctgatgatcccgcgcagatgattgcgcatttcagcctgttatttaacgtagtcaccgccttattgtttctgccgttcacacatttgttttaccggctgattgacaggctgattcctccgaaaccgtaaaaaaaccgatgcgggaaggcaccggtttttttatctgttatgaagacatgcgcatgtttcgggtcatttcatcctcaacgacgcggacgaattgtccttcgttatacggatagcccgctttttgaattttgactttgacaagtttgccgattacatcttccgtgcctttgaagacgactttcatgtaattgtccgtatagccgacgaacatgccgtcctcatcagactctttaaacgcctcttccggaatgatttccagaacctctccttcataatcggaggcgtattctttggcaagctggtcagacagcgcaatcagcttatgcacccgttcgtttttcacgttttcgtcaacctggtcttccattctggccgcaggtgttccggtgcgtttgctgtaagggaatacgtgaagctctgaaaacttatgttctttaatgaaccggtatgtttccataaattcttcttccgtttcacccgggaaaccgacgatgacatcagatgtgacggcaagacccggcagcgcttctttcagcttatttaaacggtccgcgaaaaattccatcgtatatttgcgtctcatccgtttcagaacggtgtttgatcctgactgaatcgggatatgaaggtggcggacgattttatcagacgcatccagcacttcaatcacttcatcagtgatttgacttgcttcaatagatgaaattctgatccgcttcagtccttctacacgtgtatcaagctcgcggagaagcttggcgaaattataatctttcatatcttcgccgtagccgcccgtatgaatccccgtcaggacgatttctttatagccggcatccaccagctgctgcgcctgtttaatgacttcttccggatcgcgggaacgaagcaggccgcgcgcccaagggataatgcagaacgtacagaagttgttgcagccctcttggatttttaacgacgctcttgtgcggtcagtaaaagcgggaacatccagctcttcaaacacgcgtgctttcataatattgccgacgccgttgatcggctgacgctcttccctgtactgctcaatgtaaccgagcattttttcacgatcctgcgtgccgacgacgatgtcaacacccgggatggccataatttctgccggagaggtttgcgcatagcaccctgttacgcagatgacgccgtcaggattttggcggatcgcccgtctgatgacttgacggctttttttatctcccgtgtttgttaccgtacatgtattaatgacatatacatctgctgtctgttcgaattcttttcgttcataacccgcatctttaaacagctgccagattgcttctgtttcataatgattgaccttgcagccaagggtatgaaaagcaacagttgccattactgatcacctcttaataactctgtatgataggaaactgcgcttaacgcgtaaagaggcgcagtttcagtccgtaaaattctcggtccgaggccgcataagacggcgcctttttctgaaagctgatgaacttcagactcagtcagaccgccttcagggccgaatacgattaaaagagacgaaccttgcggaaggcttttaagctccgcggcgaaagcgcccgtttctccctgctttgatgactcctcgtatgcaacgacacatttatcgacattctccgccatttcaagcagctgccggaacgtatgaacggttttcacttcgggaatttcattgcggtacgattgctccgccgcttccttcgcgattttcgcccatctctcccgctttttctttgcctttttgtcgtctagcttaacgacggatctggcgccctgaaaggggatgaacatactagcccccagctcggtccctttttggataatccattcaagcttatcgcctttcggaaggccgctggcaatcctgatttttaacggcagttcacggttttcacccgtccattcagcaatgctgcatgatatatgatctttagaaaccgctttgagcaggcataacgcttcatggccgtctttcgaacagcagattatccggtctcccgcactcattctcatgacgttcgctatatggtggacgtcttcccccgtaatttgaaaatcgggagtttcgtccatctcctgcttcgtgagctcgataaaatatcgttgcatacgctgtgacacctactaactgttattttttcgcgatgatgctgacccaatcttccatagacagaatttctgtgatggtaaagccggctttttccaacgcttcttttacttcctgttttttctggccgataatgcctgaagtaataaaatggcctccgtctttgagcaggtcatacgcctgtgatgtaaagcggagaatcacttccgccagaatatttgcgacaatgacatcatgttcgcccgtgatgccgtctaacaaattgttctgcttcacttcggccgtatcactcactttgttcaattttagattcagacgcgcgctttcaacagcgaccggatcaaggtcatacgcatgaaccgattcggcctcaagcatggcggccgcgatgcttaaaattcctgaaccggtgccgacatcaatgacacggtcgcctttttgaacgatacgctcaagcgcctgaatgcacagaacggttgtcggatgcgttcccgttccgaatgccatgcccggatccatttcgataatcagttcatcggtattcacgggtgtgtacgtttcccatgtgggtacgatcgtgaatttttcagaaattttcaccggatgataatactttttccaagctgtcgcccattcttcttcattaacttcagaaatggtgattgtgtttctgcctaaatcaatgtcgtacaaaagcagattatttatcgtctctttaatgccgtccaccgtttcgccgaggaaactgttaatcggcagatacgctttgacaatgacaccctcatcggggtaatcattggggtcgagctggtagatttccccgtaaacattctcacgctctttcattaaatcaagcggatcttcgatgacaaccccgctcgcaccagcttcatgcaaaatatttgagatgggttcgaccgcttcatgtgttgtgtgaatgctgatttcggaccatttcaaaactaccaactcctatccaatcattactcgcctttaaatgcgcgttttactttgtcaaagaaactcatttcttgttcatccggcaggtttccgctgacttcagcgaactcgcggatgatgtctttttgtttgtctgtcagattcgtcggtgtgacgacgcggacgacaatgtgctggtcgccttgtccgtagccccggacgttctgaacgcctttgcctcttaatctgaatttcgtgccggtttgtgtgccggcaggtattttcaatttcacttttccgtgaagcgtcggcacttccacttcgtctccgagtgccgcttgggcaaacgttaacggcatttcgcaataaatatcgtctccgtcgcgttcaaagaactcgtgggcgcgcacatggaatacgacaaacagatctcccgcaggccctccgtttacgccaggttcaccttgacccggaacgcgcagctgctgtccgtcatccacaccggcaggaatcgtgacattgatttttttccgttttttcactttgcccgtgccgccgcagtcagaacacttgtttttgatgatttttcctgttccttcacagtggtggcagactcttcggttaaccactttgccaaacggcgtgttctgttcgacgttcagctggcctgaacctccgcagtgcgagcacgtatccggctttgttcccggctttgcgcccgatcctttacatgtttcgcaattctcttcgcgcggaatttcaatgatcgtttcttttccgaaagccgcgtcttcaaatgacagggtcattgtatactgcagatccgcgccttgccgcggcgcattcgggtcacggcgtctcgtgccgcctccgaagatgcttgagaatatgtcatcgaaaccgaagccgccgaagtctccgccgcctccgaaaccgccgccgaatccctggttagggtctgtatggccgaattggtcatattgagcgcgtttttggtcgtctgagagcgcttcgtacgcttcttttacctctttgaatttttcatctgctccggattctttattgatatcaggatgatatttttttgaaagcttccgataggcttttttgatttcatcctttgaagcgctcttacttaccccaagcacttcatagtaatcacgcttactcatctcgcttcactctcccgaatttctcacataaattagattgtatcattttgaattatgttttttcaattccttttatcccgggcaagaaaaaaagtcaaagccaagagatgcctgactttgactttctgtctgttgaatcagaatatgctgtgtgttcttccgcctaaagccatgcgggaaagaacttattttttcgtttcgtcgtcttttacttcttcgtattccgcatcgacaacgttgtcgtccgcttttttgccttcagcgtttgctgcgccttcagcctgctgcgcttttgccgcttcttcataaagcttcatagaaagctcttgaacgattgtttgaagctcatcttttttcgctttgatgtcttcaatttcgtttttctcgatagcggctttcagcgcgtctttcgcgtcgtttgcttttttcacttgctcttcgtccactttgccttccagatcttttaatgtcttttccgtttggaacacaagctggtcagcttcgttgcggacttcgatttcttcttttctcttcgcatcagcgtcagcgttttcttccgcttcttttaccatgcgttcgatctcatcatcagaaagacctgaagaagatttgattgtaatgttttgttcttttcctgtgcctaagtctttcgctcttacgtttacgataccgtttttgtcaatatcgaaagaaacttcgatttgcggtacgccgcgcggtgcaggcgggatatcagtaagctggaagcggccgagcgttttgttgtccgcagacatcgggcgctcaccttgaagcacgtgaatgtcaacagccgtttggttgtcagctgcagttgagaatacttgagacttgctcgtcggaattgtcgtgttgcggtcgatcagtttcgtgaacacgccgcccattgtttcaataccgagagaaagcggtgtaacgtcaagaagaacaacgtcttttacgtctcccgtgatgacgccgccttgaatcgctgcacccagcgctacaacttcatcagggtttacgcctttatgcgcttctttacccgtttcttttttgattgcttcctgtacggcaggaatacgtgttgatccgccgacaaggataactttgtcgatttcgctcgcagaaagatccgcatcttgaagagcctgacggacaggagccattgtgcgctcaacaaggtgagcggaaagctcttcgaatttagcgcgggtcagtgtcagctcaaggtgaagaggacctgcttctcccgctgtgataaacggtaaagaaatttgtgtagatgatacgccggaaagatcttttttcgctttctcagccgcatctttcaaacgctgaagcgccattttgtcttttgaaagatcaatgccgttttcttttttgaattctgctacgagatgatcgatgatgacttggtcaaagtcgtccccgccaagacggttgtcaccggcagttgaacggacttcaaacacgccgtcgccaagttcaagaacagatacgtcaaacgtaccgccgccaaggtcgtaaacaagaatcgtttggtcttcgtccgttttatcaagtccgtatgcaagcgctgctgcagtcggttcgttgataatacgctctacttcaagaccggcgattttaccggcatcttttgtcgcttggcgctctgcatcgttgaagtatgcaggaaccgtgataacggcttttgaaactgtttcgccgaggtagctttcagcgtatgctttcagatgctgaaggataatagctgacacttcttgaggcgtgtagtcttttccttcgatttccactttatagtcagtacccatatggcgtttgacagacatgattgtgttaggatttgtgattgattggcgtttcgccacttcccctacttggcgctcgccgtttttaaatgcaacgactgacggagtcgtacggtttccttcagcgttggcgataactgtaggctctccgccttcaagcactgccacacatgagtttgtcgtacccaagtcaattccgattactttactcactttgaattacctcctgctatgtagttattgattcacttttaccattgaaggacggatgacgcgatccttcagtttgtagcctttttgcagttcttcgataacaatattgctgccgaagttttcatcctccacctgcatgacggcttggtgaaggttcggatcaaattcctgaccgacagcttcgatggcttcaacaccttctttttcaagtgcgtccatcagctggcggcggaccatttccataccttgcagcaagctttttgtctgctcgctttcagcttctacctgtaacgcccgttcaaagttgtcgagagccggaaggatttccgttacgacgttttgagaacggtatttctgagcagcttccatttcaaggcggctgcgtcgtttatagttttcaaagtctgcttgaacacgcaaaagcttgttttctttttcatcaagcaaaccctgcaattcatcaatttggtgctgaagggcttcttcctgacctgccgtttcttcatgctgctcttgtgaagccgcttgttctgcctgttctgtcacttcttcttgttctgctgcttcaacctgttctgcggtttgtttttcttctgacattgtgttcacctccctcaaatgctgtaaaaagatgactgaaaatgattgccaaaattcccttattcatcatacaaacttgtgaatgcttttgacaagtccgaagtcacgtgctgcagcaggctgacgactcttgaataattcatgcgcgtcggcccgataatcgcgattgatccgatctgcttcgtatcaactgtataggtggccgtgattaagctgcagttttccatttcttcgtagtcgttttctttcccgattttgattgaaatcccggcttttgatgactgaaacagcttcagaacatcctgctctttttcaattaaagataagagcgagcggaccctttcaatatcgtggaactccggctgattcagcatgttgatctttccgccgaaaaacaatttctcaacgtgggccgccggatggaatgtggagcggagcgattcaagtatgctgtcatagttggcgatatgctgccttaaatatgtgacaacctctttaaaaatgcgctcattcagttcgtccatcggcacgcccgctaatcgatcgtttaatatattgaccagtttttcaatatcggccaaatccactttagccgggaaattgatggtgcggttttcgacatgccccgtgttcgtgacgaggatggcgaccgccttatccggctggatcggaacgatttgaatctgtttaagatagttctcgctcagcgtcggcccgaggacaatcgatgtgtagtttgtcaggtcggacaggatttgcgctgatttttggactgttttttccagctcgaagattttttctttaaatatcgagtgaattaaatccagatcggtttttgtcagcttgacgggtgacagcaaatgatcgacataatacctgtaccctttttccgacggaatccgtcctgaggatgaatgggttttttcaataaagcccaattcctccaagtcagccatctcgtttctgatcgttgcagagctgaatgtaatctcgtctttttttgaaagagttcttgatcctacaggctgcgctgattgtataaaatcattaataatcacttgcaggatcaacagctgacgatttgttaacatcatcatcacccctgttagcactcaaggtcagcgagtgctaattctatatcaaaagtaacaaaccaaaagaaaaatgtcaattataactcacccaaaaaagcgccaaaaacctcatttcctaataatttgccctcatgcgttaatgcaaccgattcttccgtgtcacagatcaggcctttttcggttaaatctttgagaacatcgggaaacagttcgtcgaccgagcgtccgaatttatcgagaaaagcttgcttttgtacgccggacatttttctgagaccgaggaacatttcttcttcaatctgctcctcccgtgtcacctcgtgcgtgtcacggtaaggcagtcccttttcttcgatgagctgaatgtaatgtttcacaggcccggcgttgacggtgcgcgtgccgctgatatacccgtgagcgcctgcgccaaaaccgaaatacgcttcattgctccaatacgtcagattatgctgcgactcgtatccgggctttgcaaagttgctgatttcatattgacggatgcccgcttcactcatctgcctcatgaccgtttcatacatctcggcctcttgttcttgcgccgggagatgcaggcggcctttttgcattaaattataaaacaccgttttcggctctacgatcagcgagtaaacggaatagtgctccgcatcaagagacaaagccgttttgacggaattgtcaagatcggccagcgtctgacccggcaggccgaacatcaaatcgagactgatgttgtcaaagccgagagccctcgcacgttcaaaggaagtgaatacgtccttttgtttatgcactctgccgattttttgtaaaagctcaccttcaaaggtttgaacaccgaagctcagccgattgacaccggcatttttcatgatttttaatttttccggggacaaatcatccggattcgcttccgcggcaaattctacgagtccgtcagaaggctccagcacgcggtgaatggaatccatcaatttttccagctgggcgggtgagagcgatgtcggcgtgcctcccccgatgaaaatcgtgcggagatcagggcgtcccgtccgttctattgtatttatcatttccttttcgagtgagtttaagtacttatcgacaggctggctctgaataaaatatttattgaaatcgcaatagtggcagatatgctcacaaaacggaatatgaatataagctgatttcattttgaaacaccttcttctttacagaaagaagccgcagcgcgggactgcggcggcttccgttattttttcgggctgtcatccattttaagaacggccataaacgcttcctgcggcacttctaccgagccgacctgcttcatccggcgttttccttctttttgtttttcaagaagcttccgtttccgcgagatgtctcctccgtaacattttgcaaggacgtttttccgcatggccttaatggttgagcgggccacgattttctgtccgatcgctgcctgcacgggcacttcgaattgctggcgggggatcaattctttcaatttttcgacgatgactttcccgcgctcgtatgcgtaatcgcggtgcacgataaacgacagcgcatcaattttttctgcattcagcataatgtccattttgacgagtttggacggtttgtagccgatcagctcgtaatcgaaagaggcgtaccctttcgtgctggatttcagctgatcaaaaaattcatatacgatttccgcaagaggcatctcatatacaatgctgactcggttggcgtctaagtactgcatatcgataaagttgccccgtttcccctgacaaagctccataaccgctccgacgtaatcgttcggtaccatcatcgtcgctttgacataaggttcttccacccgctctattttctgcgggtcaggcatgtttgacgggttatccacgatgatcttttcgccgtccgtcatataaacgtcataaataacgctcggcgcggtcgtaataaggtcaattttaaattcccgttcaatccgctcttgaatgatttccatgtgaagcattcctaaaaagccgcagcggaaaccgaagccgagggcttgtgacgtctctgcctcgtattgaagagatgaatcgttcaattcaagtttttccagagcttcgcgcaaatcattatatttggctgtgtcaatcggataaagtccgcagtataccatcggattgagtttgcggtagcccggaagcgcttctgccgcaggcttaaccgcgctcgtgatcgtatcaccgacacgggtgtcgccgacgtttttgattgcggctgtcaaatagcctacgtcaccgactgtcaattcgtcagccggctgcgctttcggcgtgaagacgccgacttcgatgacttcaaactcttttccggttgccatcattttaattttctggcccggtttgaccgttccttctacgactctgatatacgcgacgactccgcggtacgcgtcataaagcgagtcaaagatgagcgctttcagcggagcttccggatctcccgcgggagccggcactttttctacgatctgttctaaaatgtcttcgatgccgatgcccgctttcgctgaagcgaggacggcgtctgaagcgtcaaggccgataacgtcctcaacctcttgacgcacacgttctggctctgcgctcggaagatcgattttattaatgacaggaagaatctcaagatcattatcaagcgccagatagacgttcgccaatgtctgcgcttctattccctgagccgcatcaacaacgagaatcgcgccttcacaggcagccaggcttcgcgaaacttcatatgtaaagtcgacgtgtccgggcgtgtcgatgagatggaatatatattcttctccgtcttttgctttgtatttcagctgaacggaatttaatttgatggtaattccccgttcgcgttcaaggtccattgaatcaagcaattgttctttcatttcccgctgggtgatcgccgatgttttttctaaaatccgatccgccaaggtcgatttgccgtggtctatgtgggcgatgatggagaaattccggattcttgactgcctctctaaacgcttttctttatctgtcacaatctatcactcctactattaaacgcaaaatacactagcttagattatatcaataggattgtaaacattcaattaaaacaagaaagagaaaagcttcctttaaggaatcatccgcttttctcttcatcaatgctaacggttcagtttcgaaacccactcatacatcgcctgtgccgagtccgtcacggtatttgaaagggtttctccggcttttgaaaacaggttgaaggtttctgcctgttccagctgtttttgtttttcttccagatctttcgccgtaacggtttgccccaaaatggaagcttctttttcctgtccttctccgccgccgagcgtgaatgctccttttaaggagggatctttgtatcctttcatatcaagcattccgctgtttgcctgctgcatgccgaacaatacgccgacaaacatgacaatggcgatcagcaggcatttgccggtaaaacggatcatttgcatcacctgatttctattgttttttcttctctcctgattgcgagctgaccttgtctgcatcccagtacagttcgctgaatacatcggccacggcatctgatgcgcgcctcagttcttcaagattgttatccacgccccgaattccagcagaagcgaccgatcgtttaaatcctggttgtacactccattatctcccggagagccttttgataaaacaccgacgcttaagcctgggtattttttctccatcagcttatgaagttcacttgcgagtttatagttttcttcaaaattagcgctttttttgccgacgacgatggcgaccctggcatagctttttcctttgatgtcggctgtcgtatttttcttgcggcgggaatcccggtgaatgtctatggtatattgcaggtttttatttttggcgagcgcgctttttacgaccggccttgattcgtcgtagcttcgcgcataatttaaaccgtctttgttcaggcgggcctgaatgtcggttttatctacggtcgctcctacaccttgcgcttcaagcgcttttccgaacatatctccgacaagcgtgacattggccttcgaatggcgggcgttatccggatttgtttccccttttaacagaggaagataggattcggtattatgagtgtggtaaataaaaacgacttttttgctgcctgttgaatgtttcggcggcgccttttcttcttttttcgttttgttttcgatttctgccaggttcacttctttttctttttccatcacctttgacggcggcggggattcagcaggcatattcgtataatcagtcccctgccccgccagaaggatctccgtatcgtattgggcaaatcccggcagctcacgtcccaagaaactccgcgggtcttccatattaatgcttgtcgccagttttaaggaaagccgggacagctgaaaagagtctttttcaggaagctctgaggcgaaataatgattttccataccgaggaggtgtgcaaacgcgtcacccggaagttctccggcaattccgtgaagagaattcgaagaaagcctcagttcagggcgaagcgatgtgagcacacccgataatacgaaaataacgataaggcttgtcataaacaaaaacatgcccttgagcgcatttccaccgtttactgcaacgacaatttgacggtttctgcgtttttttctcatgatttgaatccctccagcgcttgtctagtaattactctatgaacaagctagaggaggtagaaccattttaatgattataagaacctttgttatcttgtgacactttttcatgaagggcggtgtttaacccgtttgcaagcacgttcgccatatcatcaataaaggtgtcaatctccttcggtgtgaccatcagattatggccgagcggagagagcacttcgtgaatcagctggcgtttttcgttttcgtccagtgtgccgacaataccgagaaaggattggcgttctttttctccgggaaggtcttcgtctgtcagcaccttctttttgccgaagttcattccggcgggcaccagagatcttgacgggctgtcatctttcatctctctgccgaaatgctttaatatataatccaccgtatcgctcgcgatcgtaaccgcatcaacgacagtcggtaccccgattgcgatgacggggatgccgagcgtttccttgcttaattcttttcttttattgccgacgcctgatcccgggtgaatgcccgtatcagaaaattggatggtcgtgttcaccctttcaacggctcttgccgcaagagcatctaccgcaatcacaaaatccggctttgattctttgatcacaccttgaataatatcgctcgtttcaattcccgttaatcccatcacaccgggagcaagcgcgctgaccggcctgtacccttcctgcacgttttccggctgaagcctgaacagatgccttgtcacaagaaggttttcggtcacgagagggccgagcgcatccggcgtcacattccagttgccgagaccgacgatcaaacagcttgcatcctttggaatctttaatgccgacagataggcggaaaattcctcggcaaacacttccgttactttttcctgcatgtcagagtcgtgttcccgaaccccttgagcctcgatcgtgacatagcgtccctgctttttccccgatagctcggcgccttctttggtaatatcgacggttctgactttaatgccgcccttgtcgcgttctttttcaataaacccgtttatttcttttgtctgaccggcttgtccgtcttttaccgcctgtttcgtttctaccgctaaatccgtccgtatcagaaattgattgacatccagttcgttgtttttcacaggaaagacctccttcaatcatcgtggtacatagtgtggccatttacaaaacgaatcatgcgaatttacccatcaacgaaaaatactttacatttatattgcaatctaaagttctgtttgatagaatacaatttgttctattgtgaagaagatttaaccttaagacactgtgctacaggttgtatcttaggaggtgaaacacatgccaaacattaaatcagcgattaaacgtacaaaaacaaacaacgaacgccgcgctcataacgcgacaatcaaatctgctatgcgtactgcaatcaaacaagttgaagcttctgttgctaacaacgaagcggataaagcgaaaactgctctttctgaagcagcgaaacgcattgataaagcagtgaaaacaggtcttgtacacaaaaatgccgcagctcgatacaaatctagacttgcgaaacaagtgaacggactttctgcataatacaaaaacgatccctttaacggggatcgtttttttcattcagtccggagaagctcaaggagaaagagctccagcaagagctgcttgtcctttttccccgttttcatttcataatccattactgcgagcctttctataatacgccgcagctcttcttcagaaaatagcctcgcctgatccatcgccagctttacccggaaggggtgcacctttaagttggaagcgatttgcttttggccgtatccttgtcccgcaaaatactttgtctgcataatcagacggaattggttggcgatcagcgccataattttgatcggttcttcgttttgttttaaaagatcataaaatatttgaagactttccgtccgttttcggttcacgattttgttgatcagctcaaaaatattctgctccaaacttcttgcgacaagctcccggacatcttcaagcgtgatctcatgtctgtcaccggtgtaggcggagagtttttgtatttcctgatatatggaagacagatggccgtttgcaagcagaaccaaatgctcggcagcttctgtatccatcgttttattttcggatttcgccagattaatcgtaaaatcagtcgtctcctttgcattcagctccttagcttcaatcataagggctttttgcttcagcgctttcgtcagctttttccgttcgtccagcttttcatacggagccacaatcacaaagaccgtataaggcgcaggctccttcaggtaagtctccaaagcgcttgtattatgctctattttttctttctttttttcccctgttaaaaaagacggattttttacgataaccagccgcttctctcccataaacggaaacgtttccgcatcggttatggcctggtcaagcggatcctcttcaagatcaaaaacagacaggttaaaatctttagtctcctcatcaacgacagcttgtctgatccggctgacagtctcttggagcagatacgtttcttttccgtataagcaataaacggagcggacatccccttttttcagggctttccaaacatcaaataccatgatcgtatgacttcctctctttcttgatccccttctatcctaaattgagttcggcaaatagtaaagaggaagctttaaaaaggacagcttcctcatttataataaacgcctgattcacaagctcccgggtctgcttgtaaaaaggcgataatcacaagaacagaaaacgttaccatcacttctagatttttcaaaacaattccagtatacttagggaagtcaggagggatgaaattgaatgattttgaaaaaaacgttcaaagcaaacgaaatgatgctgttgactcagctgtcggttttgtcgtgtccttcggatttttcgcctttttgttcgtgatggcaacagccatccatcttatcggctcttagccgcattccgggctgctgtcaatcggcagtcttttttacttcttgcgccctggtttcttctatatcatatggagggaagacggaaaacgttccggcgcctttttcaaatctgtattgaatcgttccgctgatatcggtgcgaagcacattgacagagtacgccttcaaacgatccagcacttcttcgtgcggatgatggtatcgattctcttttcctgctgaaatcagcgctgcttccggctgaagctgtttcaaaaaggcttcactcgttgagcttttgctgccgtgatgacccgccttcaatatatcagccttcagtttcggatacgttttcagcacttctgtttcgccgtccgattctaaatctcccgtcaaaagccagctcactccgcctaaaaccgtccaaagcaccagtgacgaatcatttttactctttccgtcagacgactccggagacagcacctgaaactgaagatcaccggctgtaatggtgtcgccccgctttgcttcggcaacgggaatgttgttttctttcgccatatttaatatgttctgatccttcggttcttttacgaatcccacggggacaattaaccgtttgactctatgatttttgattaacactccggcttccccgatgtgatcctgatccgcatgggttaaaatcagcgcatccagctttttcaccccttttccgtttaaaaacggaatcaaaaccttctcgccgatagaatacgggtggcgtttttctttccatgattctccgggataagcaatcactccccctgtatcaaccattacggtccctttgcggtgcggcgcgtttataaacagcgagtctccctgcccgatatcaagcatatccgcttctccccatgggctgaaatacggacggcatattaaataagccaaaaccgcgcagaaaaaaagagccgatttcctgagttttaaaaaacctcccttttctaaagccgcaaaaagcgtaaaaacggaaaccgcaagcagaagaagggaaagaaagtcaggctttaacacaatcatagtaaataaatcaacggatgccgcatatgtaatgaaatcatgcacaggcttcatcacaaggtcaaacatattaaacaaacattctcccatctgccttgaaagtaaaagaagaaggaaaccgatgacagaaaccggaatgacaaataacgtataaaatggcaccatcaccatattcatcggaaaactggcaagtgaaatttgctgaaaatgatagagaagaaacggaagtgagctgagctctgcaatgaatgaagccatcgcaagcccggcaagtctgcttttccctgctttctttaaaatggaggatgacagaattaaagaggcgcttaccgcaaaggaaagctggaagcccgcctgccaaaggaggtaaggattaaacagcaggagcagcagataagacagagacaatgcagcagaggaatgaatgccgcgtttaacaagagttccggcgatataaaatcccagcatgagggatgcgcgcaatacggatgggcggcaccgctcagcagcgtatacaccggtaaaaacagcagcagcaatatccccgccttttctcttgtcagcccgattctgatcagagcataaaataatcccgccgttataagaccgacatgcattccggaaatcgccattaaatgaacgactcccaaattttgatatgcactcagtatatcgtcttctatagaaaatctttcacctaaggtcagcgcttcaacaattccggcggaagattcaggcacgtgattccgaatgatcgaaatcaaattttttctgatgctcagcagtttaaacagcggctgtttggatttttcacactgctgaatggaagtcacggtaaataaccagtgaatctgctgagagtaaagatattccttataatcaaaacccccgggaatcgtcgcatgtgcaggctgttccagagagcctgtaaatgtgcagcgcatccccggttcaagctgttcaatgcgtctcttttcttcaagagaccggattttgtacgaagccgcccatttttccttgtcatgtgtacggataacggctgacattttcgctccgtcaaccttcggaatattagtgatgacggcctgttcagtataactgccggcctgataccgcgttacattcacagcgtcacaaaccgtataaagaaagaaataaacacaaaaagaaacgaggcagatgataaccggagcaggctgctttgtttttatcataataaagagaagatacagaagaaaaaggagcagaacccagaagacatgagcggcggcaatccccgcagttgcagaaaccgccgccagaggcagaagaaggtatttatatttcatttatacgtaactggtaaacagctcattggcctgttcatgaatttttttcagttcatctgccttaactcccgcatcagataattgctgaatcagacctgcgacaaaagacaatttttcgcggtttttcagatcgatgatcatttcatcaagttcgacctgctccaccttgactccggcttggctgaacagctcttttgcataaggctgtgttttgtaatcttcggcataatagaccgttttgatgcctgcctggataattgatttgcagcattgaatacaaggataatgcgtcacataaatttccgcgccctccgtcggaacaccgaacttagaacattgcagaatcgcattcatctctgcatgtatggtcctctggcaatgattatctattaaaaggcatccttcatcagcgcaatggacgccgccggcgattgagccgttgtatccgccagcaatcatccgcttatctctgactacggttgccccgactgacagtctcggacatgtgcttctcagcgccagcaaatggctttgcgccataaaatattgattccatgagattcgttccacaagtgttccctccaaaaagtcttgttgcttttctaagtttacatagatttaagcagaaccgtcaattcactttaccgtaatggaagtttttatccgctcaaatgacttttctccaaagcctgatacattcatcaaatcttcagcagtctgaaaccgtccgttttcttctcggtaggcgataatagcttccgcttttttctgccccaccccggaaatcgcctgaagttcgtccagagatgccgtattgatattgacagctgcattctccttttcaccaactgctgttttcgggcgattctcctcttcgccttcactcggaatataaacaatcgtcccgtcctgcagctgctctgctaaattaacattcaattcatccgcctttttcttcaggccgccggctttttcaatggcttgcgtcactctgtctcccgctttcatttcatacacgccgggatttcggaccgctcctttcacatcaatcataatcttatcgtctgcggtgtcttttttgtccgcgacggatgcggaggctgtttgaccgagcacggactgctgtttgaccggctcttccttttcagaacgaaacagccaaatacagataaaaaccgcacctgccgcaagacaagcgcccagaattttcaggttccgccgcatccgctccgtcatcatcgctttcgtcatattgcattgcctccccgcataaggtttagaggattaagggaaaaaggaggggaattcattgaaaataggctttatcggcaccggaaacatgggaacgatcctgattgaatcgtttatcgaatcaaacgctgccgatccctcacatatcaccatcacaaacagaacaatcgaaaaagcattaaaactaaaagaacgtttcagcggcatccacgtcaccgaggatcaggaaaagctcgtacaggataatgaaatcatattcatttgtgtaaaaccgctggatatatatcctttgctgaaaaaactcacaccgcatttacggaaagatcacattttaatctccattaccagccccgttcagacggatcagattgaacatacggttccgtgtcagacggcccgcgtcattccgagcattacgaaccgcgccttggccggcgtctcgcttgttacgttcggcaaaagctgcagcgagtctgcaaaagcggatattcaaacgctgttcactcatatttcaaaacctgtggaaatcagcagcggtattacaagagcggcgtcagacattgtcagctgcgggcccgcttttatgagttatctcgttcagcgctttattgacgcggcagtggaagaaacggacatcaccaaagaagaagccgtgattatgtcgacagaaatgcttgtcggtctcggaaagcttcttgaaacggggcattacacgcttcccgccttgcaggaaaaagtatgcgtaaaaggcggcgtcaccggagaaggactgaaggctctcgaaagcggtgttcaggatatgttcaatcgtgtctttcagcgtacacatgacaaatacgatgaagatatatcgttagtgaagaagcaatttcacgtgtaactgagtatgccataaagagctttatcacgccaatcgcaaaaaatgcattttaaaaaccatcgttccgtttaaacgatggtttttggtttgcctgccgtaaagaaaagacgttcagactctgttgaaggaggccggtctgtaaaatcagccgtcactttcttcaattcaaatccggtctctgcaagcatttgtttatattcttcaatgtaaaatgttttttgctcatgcgtctcgtcatagcggtcataagattgtccgttccatacgaaaaaggacatatcatggatgacagaaagctcttcatcgccggcaaagctttgccagatatagctgatctgctcatcctgatccgcatgggtgctgtccggaaaaagctccgtcattttatacggggaatggacgtcaaacagaagcaggccgccctccttcaaaacttgaaaaacacttttgaaggtgcttaagacatcatttttcgtttttaagtaatttagggaatcacagcagatgactacggcatcaaactgttcttcaaaaccggaaagctctctcatatcctgctggagaaaaagaatcggctttcctgtttttttctgctgggcacagctcagcatatcttcactcaaatcaatccccgtgacttcgcagcctttttcagcaagcctgatggatatttctccggttccgcaggcaagatcaagcacccttcccttttccggaagagacgcttcgatccagcccgcccattcatcatacggcgcatgggacattaactcgtcatatacaccggcgaagccttggtaaatcatgagttcaagccgagttcaagctctgcgagcggcgcgtcgccccatagcttttcaagattatagtagcttctttcatctttatggaaaacgtggacaatgacgtcgccgagatcaactaaaacccagcgggcctcatcaaacccttccatctttttgacatcaatgccgttttcttctgcctgatctttaatttcgcgcgcaatggcctgaacctgtttatcagaattcccgtggcagattaaaaagtaatccgctacaagtgagattccttccatgtccagcgctaaaatatcttctgcacgtttatcgtcgcatgcttttgccgcgatttttaatacggaagcttgattcattttccatattcctcctgtcgtttttgagacaccagccagttataggttgcaaacgtctccggaaagaccggctggttttttttcatcagaaatatcattgtatttttcatcgcttgtatgagcgcttcgttcagatctgtttccgccagacggcgcacctcttccactccgggaaaatggcggccgggttcaatgtaatccgcaacgtagatgactttgtctaaaagggtcattccgggacgccctgacgtgtgatagcggattgcatccaagacctcgggatcagtgatccccgcttctttctcagccaaatacgctcccacaggggcatgccacagctcggcattgtaatccaagagctcagcaggcattttttcccgcacgatgatctgcttcatttcttctttcggccggaatttcgcataatcatgaaaaatagccgccatttccgcttttttcggatctgctccgaaccggcctgcgagaataaccgccgtatctgtcacgccgattgtgtggatgtagcgatgctcggtcagctgttctttgacgcaggcaagtgcttcctcacgattcatataaatcattctcctctatatactgcctcactttatccggcattaagtattgcgtcggcttttttgctttgagacgttctctaagcatcgttgacgaaacgtcaaattccggaacgtcggcaaaaagcagcgggtacggggtctcgatatgataccctgggcgccgcactccgataaattgaatgagcgtgagcagttcgtccagtttgtaccatttcggcagatattcaatcatatccgccccgataataaagaaaagcttgtcgttcgggtgccgctccttcagtaaacggacggtatcataggtataagaagggcctttccggtccatttccgcaagctcaagcttaaagaaggaattagagctgatggcaagcttcagcatctccacccggtgccggctgtctgtaaagtcttcattctgcttatgcggcgggattttattgggcataaaccaaatctcatcgagctccgcctgatgaaggacttcattagccatcagaagatgtccgttgtgcggagggtcaaatgtgcccccgaatattccgattttcttcatgtcaaccaccttacggaagctcgatttgtttattttcctttgattccttatacaatacgatcgtatttccgatcgtctgcaccaattgtgagcggctgcctttcacaagcgcttctgcgacatcgtttttatcgtcttcgcagttttgaagcacgctgactttaatcagctctcttgcttctaaagcctctgcaatctgtttcaccatgttttcgttgactccgccttttcccacttgaaaaataggcgttaaatgatgcgcttttgaacgcaaaaaccgtttttgttttcctgttaacattgtgttcctcctagttttccttcaacaattgctctcattaagccgctgtcaggctcttgttccgtccacagcttgaaagacagtgcagcctgttccacaaacatgccgacaccgtcaagggttgttaaacctcttttttcagcttcttttaagaacgccgtttgaatcgggttgtatacgatatcacaaacgatggcgcccgttttggcccgttccaatgagagcggcacggcatccgttttcggatacatgccgacagatgttgtatgaataatgacgtcatattgttcaagctgattttcagcttcttttaaagtaagggcgcgtttctgctgaaaagagggagcagccgcaatcagactttccgctttttccggcgtgcggttgcaaacgtcaaattgtttcggctctctgcggacgatcgtcgtaaaaatcgctcttgccgcccctcccgccccaatcatgaggatggagagctctgatatcggtttgtccaatactttgactaaggatttataaaacccatctccgtcagtattatacccgatgagcctgtctccctctcttttgacggtatttacggccccgagtactttcgcgctttcatgtatttcatccagatgctccatgatcgcgactttatgcgggactgtgacgttcactccgcagatgccaagcgccttgattccgttaacggcgtccttgagataatgaggttccacctgaaacgcaaaatactgcccgttgatgttcttatcttgcaaagccgcgttatgaatatcgggtgacattgaatgcccgatcggatttccgattactccgtacaattgtttcatgctccctctccccttctctctatattaatgaacggcggacaaatacgtgtacgcctttcggagcgtatgccgttatttttttatctgcttgctgcaccgtgacccagccgagtccggaaaaaacgatatccgtctttccttctttaatcgtaaacgtgtgggccgtaagctccggaaattcatccaaatgatcttttccgggcggggtaagcagttctcccgcatgcttttcgtataaggcatcagcattttcaagctttgttctgtgaatcatcaattcattcggcatatagcagacaaacgccgttttatcgcctgatacatagtcaaaccgggcaagcccgccgaaataaagcgtttgtttttcattcagctgaaaagtgcgcggcttcagttcttttttcggtgtcagcacctttaagtcacgcttgtccacgtaatgcgccatctggtgatggttaatgattcccggcgtatcataaagcgcagatccgtcatcaagcgggatttcaatcgcatcaagcgtcgtgcccggaaattgagaggtggtaataatattctcttcccctgagacctctttaataatccggttgataaatgtggatttgccgacattggtacaccccaccacatacacatcccgcccttcgcggtaatgttcaatggcgtcaatgacttccttcatcccttgtccgcgggaagcgctgattaaaaagacatcaaggggttttaagccgtattctttcgcttcgcgtttcatccattggacgagccgttcccgctttacggatttcggcaggatatcggccttattaccgacaagaatgatcggattaccgccgacaaagcggttcagcccatttatccagcttccgttaaaatcaaaaatatcaacgactttgacaattagagagtcagtatcgccgattgtgtgcaagatatttaaaaagtcatcatccgttaatgaaacatcttgaatttcattgtaatttttcagtctgaagcagcgctgacaaatgacattctccttcgtgagcgatgcctttggcgcgtatccgagaccttgtttatcctcggtctggatcgttactccgcagccgatgcaaacaaccttttccattcctaatcctcccactgaatatggcctttacgtttcaaagaactcaatattctccgttcaatccggcggttaaagcgcgtcatgactccgtcagaggaagcgacaggcacgacgaggatcgtatgatacccgtttctgtttccgccgagaacatcagtaagcagctgatcgccgatgaccacacagtcttcttttttcagctccatgctgctgacagctcttttaaaggcgcgccccatcggttttcttgccttataaataaacggtatgccaagcggctccgagaataatttcactcttcgttcattattattggagacgatcgtgactttaatgccgtgctccttcatttcttcaaaccactcgattaatcgaggtgtcgcactcggtctgtcccactccacaagcgtgttgtcaaggtctgtaataatccctttcacattgcgttccttgagcttttccggtgtgatatgaaatatatttttcacaaattcgtcaggtaaaaaaaacttttttaacaaaacccgcacccttccttttctttctatcatctatatgtcgaaatctgtcagatttaaaaacaaagtcggactcggtaaaaaaatttcgacaaaaattgggtttcttcaccagttgtggataaaattacacacattatccactcttattacatccggatttatccagattataaacaagatactaacaagttatccacttacgagtgtggataacagaacgattgttcttatttgtatttcatggtagattaaagataacctcaccatgattgaaacgcaaccttccatcatatgcttgcgtctgatgattgattacaattgtaaggaggtgccactcccattaattgggtccccggcatgagaaagctttctgatgaattactaatagaatcttatttcaaagccaatgaaatgaatttgagccgtgaatttatcgagttaattgaaaacgaaatcaaaagaagatcgctcggacacattatttccgtttcttcttaaacagaaaaaattcccgggcgaatttcctttttttactcagatgactgatattatatcacttcggttatgcgcattactaccactttcaacaaaaaacacccctaaaatagaggtgtttaagaggacggctgctatatattgaaccaatacagaccgcccagaacgagaatgacgacgagcagcacaacaaaaaatgcgtaccagtaccccgcattcacccgaggaggcgggcatacaggatattgcggagggaaaccgcggttcatagcaatcgcctccaaaagatgttttttctacagcctatgaagcagaagcaaaacggtttaggcagctgacggcgtcagcgttccaaaacccgcccattttttatgccttcaattaagattctggcgccttttggcgtcatatgatttccggagggatctatcagtccggattggatcagcgcccggtctgtatctttgccgccgtccgcgcgtataaagtgtttccagttatccaccagcggcactttcaactcagctgcaacctgcctcgtaacgccgttataggaattatgccatgttctcgcgccgcctttttctttaaaggctgaggctttatatctcgaatagtaatagagatgatgcgttccgtttccttctataaccgggatgcacgtcattaaaatcggctttatgccgtgatttctgctttcgtttatgaaataagtcaggttttctttaaaccgtttctttgatactcgcggctgatctcccgtcaaaatgcccgcatcatttgttccgaacatgataaataaatattggggcttacgctccagcacgtcgctttgaaagcgcaggcgcgcatcctcagtcgtctggccgcctattcccgcatttataaccgtaagacggccgcgttccgctgtttttaaaatgtttacccactgctgcgccttcggataatcacgataatcccagttggaaccgcgcgtattgctgtcgccgaacgcgacaacacttttctctttgcccgcagcgcatcctgataacagacaggttatcgtaataaaaagaacagcaaacttcattttctctccccccaaaccttacctcctatggtacacatctctttggcggctttcaacgcggcgctctctttactggatatgaaaaggaccggaatcctgtccgatcaaatccgaaaccttaacaaacgtgtagccctgctttttcagctggggaatgatttctttcaaagcctcaaccgtctggcgccggtttcctccgccgtcatgcagaagaacgatatctccatctctggcatgtgaaacaacgtgcctgacgatttttccttttccgggccttttccagtccctcggatcttggttccatgaccacatgatgatatgatagccctcttttaagaggcttttgaaagccgtatgattcagcgaccctcccggcgggcggaataacttgtccccttccggctgcagcgatctgatatgatgcgcggagctgtgaagctcttgtaaaatgtctttgcgttttaaacggtgaaaataaacatggttcatcgtatggttgccgatttcatgcccttcttcaacgatgcgttttgccgttacggggtatttgtctatacggctcccgatacaaaaaaaggttgctttaacattgtgctgtttcagcacgtctaacacagcctccgtatagacaggatgggggccgtcatcgaaggttaaagatagcttctttttttcagaccttatatcccagtacacgtttcccgtcttctccatgtcacttctttttaaagatttcgcatcggcggacacggcagtgagacccgtgaggacgcatatcatgatgatcagatgaaagcatctcaacgtttacacctccagtaaacactactgttaacgtgtccccttttgtataaaatcattctctgcatcaaatgatgcacatcacccgcttcccgcatgtttttgtccaaacccggctgccagccgtttctcatcaaacggcaaatgctgataaacaagtacgcttatcggacagcttattttaatagaaggagatagatttgtgctgtatactaattgaaaagaggtgaacgtacagatgataaaaaagggattcagtcttgccgtcatcattgctgtcgtgatgatcggctttatgcaaaaagacgtctggctcagcatgattcgcgcgggcggcatgtatgccgtgcttatgagtatccttctggtcgcagctgacgtattttttccgatcgttccattcgccattatcgcggccttaaacggagcggttttcgggattgtaaacggagtgtggattacattgtcaggcgcaatgctcggaacaatggcattgttttttctcgtccggtacggattcagagactgggccagaaaaaaactggtggcttacccggccgcggctcaatatgaaggttcatttcatcagcacgcgtttacggcggtgcttttcgggcggctgattccgattataccgtcgcttgccatgaataccgtctgcgggctgagtaacatacgatggccgatctttttttctgcgtcggtgctcggcaaaattccgaacattgtgatcgtgaccgtcgcaggcgcttcatttacaagcaacaaactgctgtctttcgggatttacggaatgtatatgctcgtcttaatggcggtcatttataagaagtttcccggtcttttaaaaacaacgaaaaaatgaagcgcgtaccgcctcctattccggcggtacggctcctctcattctgagaacttttccgtttaattctaaattgatgcagcttcgttccgcgttctctttgctgctcagtaaaggtgcacataaccgattttttggctgcggtaaaagttgatggaagcttcaagctgtccgatcggctgcccgttatgaagaagcagcttaaaattgtcgggtgagcattagatttgggatgacagccacctgagatactcatcctcacgaaatgaaacggccgtctctttatgtttctttaaattgatccgcttgaaacacatcgggagtcctcctttttgaggccgcaaataagaacgagcataaaacggctgccaacgccagcataacagcagcccctgcgatgacgatgacgcggacggaagaaccgacagccgccgctccgaaaaccgccgttaccaatataatgaagacggcttcgactaatgaataaaagctccccactctccccatgatgtccaccggaacattcttttgataaaacgtcagaaagcctgtattggcaaacgccagaaaaaaagcgagaaggaaaaatccgaaagcagccgtccaaaaaacgtcagaaaacgcataaatcatatatccggccgctgtgaataaagagcccattcccatcaataaagaagccggcatttttttattaaagattacattgacaagcgcccccgcaataatgcctgcccctgagacactgacaagaaaaccgtaatcggcatcagtcagctgaagaacttcttttgaaaaagcggcttcaagcgaatcaagcgcggatggcataacggtcatgaccagactgaataaaaaataaatgatcatgacgtttcgcgccgttcggctgaagcgatagacgagcttccaatcttctttgcacactgccaaagaaagcttctgtctgggagaatgtacgtgaggctcattttcaaggctcggcagcatcatcgtgatgaaaccggacagcactaaagccgccgcattcacccaaatcgcaaaaatcggcgtgccggcgataaaaagcagcccggccgcagccggcccgaggagaaaagcccctgattccgacaaagcccttagtgaattgaatcgttttctcctttcagccggaataagcatcgtcacatacgccatggaacacggacgaaacatcgcattggccatttgaatcaaaaacacgatacaataaatggaaaacaaagaccttacagtaaacatcagcggcagaacggcaatgaatgcagcccggatgaaatcaagcgacatcatcatattccgtttgttacacctgtcgatgatgctgcccgcccacccatttgtcatcaaaacagccgcaggcctgattaaataaaggatggaaaccgcaaaagcagaccccgtttcttttaaaacaataagattaagagacaaaaaataaatccattcaccaatatttgctatcccgattccggttaacagaagcatcgggtaccgccaagacttcaggtttttcatcttatccctcccttagaaataaaaaacgccctcaagacaataaagtcttgaggacgggaaacagcccgctatgccacctcaattcggtttggtgccggcctcttgccgggtacaaaacttactcggtaacaggagtatccgccgcatcatcctcgtttttcatgattccgatgcgaagctaagaggtttgtttcaacacatccattcatactccttcacagctcccggagctctctgtcatgaatgatatctgtctactcgtctcttcagcgcttttcgttatattcttttcacccttactttttttaacaatatacaggctcaatcagcaaaaatcaagaggctgtaagaaataaaacctgcctttgattaatttccctgtacagacacaaacagcctgactgccacatacagttacatataggcttttgcctacataactttgtggaggtgaggatggtgacaggtgtttttgcagcgctcgggtttattgtgaaagaactcgtgtttttagtatcatacgtgaaaaataatgcctttccacaaccgctctcaaatagtgaggagaaaaaatacttagaccttatggctgaaggcgatgaacatgcccgcaacatgctgatcgaacacaatctccgtttagtcgcccatattgtgaaaaaattcgaaaatacgggagaggacgcagaagatctgatctccatcggtacaatcgggctgatcaaaggaattgaaagctactcagccggaaaaggcacgaagcttgccacatatgccgcacgatgtattgaaaatgagattttaatgcatctgcgcgcattgaaaaaaacgaaaaaagacgtctcccttcatgatccgatcggccaggataaagaagggaatgaaataagcctgatcgatgtcctcaagtcggaaagcgaggatgtgatcgacaccattcagctcaacatggaacttgaaaaggtcaaaaaatatatcgatattttagacgaccgcgaaaaagaagtcatcgtcggccgcttcgggcttgatctaaaaaaagaaaaaacgcagcgcgagatcgcaaaggagctcggcatttcaaggagttacgtgtcgcggattgaaaaacgcgcattgatgaagatgtttcatgagttttaccgggcggaaaaggagaagcggaagaagaaaggaaagtgagcgaaaagccggatctgacatcccggctttttctgcattttaggacattcctcttcaagtataacttcaggatttaaaagtaaaacataacaaatgaatagaattggtacaatcgttaacctttttaatgattttgaacctcataggaacccttacatgacaggatttttgttgtttttcattgtttatcaagatctaaagcaaaagaacttgctatttctcaaatacatccaccaaattttcaatgttagtttgcttttcatacatactactaataaaagtaaaaccttattagaactttacaagacaagctgaattgactatagtctaattagactaaaatattgatgtaaagaagtgaaaaattaaatgataaagtcttttttaatgttggggcagtcgaatatggcgggccgtggatttttgaatgaagtagaccctatctataatgaaaaaataaaaatgctgcgcaatggacagtggcagatgatgacagagccgattaattacgaccgtccggtttccggcgttggcttggcggcatcttttgcagatgcttggtcgaaagctcatcccgatgaagaaattggcttgatcccttgtgcggaaggcggcagttcattgaatgactggcatccggaaggcatcctttttcagcatgctttgtccgaagcccgcttcgccctccgttccagtcaaatttgcggaatcctttggcaccaaggtgagagtgacagttatcgttcgctgcatgaaacttattacgagaaattaactcttatcattgagacgctaagaaacgagttgaaacttgatgatgtaccgttgattattggagggcttggtgactttcttgggaagaccggttttggacagcacgcgactgaatttcgacaggttaatgaacaattgctgcgttttgctaatgaacaacagaattgttattttgttactgctgcaggtttgactgcgaatcctgatggcattcatttagacgcagcttcacaacgcaaattcggttaccgctatttcgaggctttctcgaaaaagcaccatatcctgaaacccatttcgggagaggagcaatcactgaaagtgaagggtgactattctaaaacagaacagatttaccttcatagtatggatttggcttcgggtaaaatcacgtacgcggaatttgaggcgcggatggagaaggtgatgaaaccatgattcccttacttatccttggcttgctcatccaaaaccccggagctcacggctatgaacttctggccttaatggaaaaacgtcattacaaatacattgttaacttcacgaaaggttcattttattacaatctgcagcaacttgaagaaaagtgtttgattgaacagattcagcagaaaccctcaaccagcgggcgtgaaatccgtaactttaaagtcacagattcgggaagggcagaatttgaaaaattaatgatcaaatacggcaccaaatcggaatatgtgaacctgcaattttatggggcgttactctttgccgatgaattcgacaaaaataaattactggaactgatccaatcacaaatcgatcagactaaaactcgaatcgagctccttgatgaatacctgtccatcactcaagaaattcccggcacaatcaattactttcgccgtatgaatgaaaattcccgttcacatcacttggttaatttagagtggttcgaaaaattgaaagcagaaatagagtgaactattgcataataaaaaaatgcaatgtggaatatataagaatattttagctaaatataaaacctgtgtcgcagatatctagtaacatcattgatacaggttttataccccttctttaattaaaccagctaatagggttgtcaacacttgccccaaacaagagcaagtgagtctgctgcgtgttcttctttttcaatccgtatgaataaccactttttacacctattcagtattcaagtaagtcaactgatttttctccttcttccgctaaactgctgctttagtcgaataaaaaaagtgatctcccttaaggaagaatcacttcctctaattgaacaagcagtgaagatgaacatcgttctcgacatcaactaaaattttttaactgcctccgcgtatgcagctttcaattgattgatagtaaacccctcccgcaagaaaactccgtctttttctattttcttttcaatataaaacaatgataactttctttcatcttatgaaacccaagcagttattaggtgttttctttatctgtacaaatacaggtgagtaacttaatttattacatataagttatcctgcaaaactgtgcacgaaatgtcgggcagatacatttcgctcctgttattcttttgttaaaggaggtcaaataaatggattcgcttaaaaggatgaacagcgcattaacgtatattgaagaaaacctcacgaacgctattgatttcaaagaagcagcaaggcttgctttctgctctgaatatcattttaaaaggatgttttccttccttacaggtatttcattatcggaatatattcgccgcagacgtcttactcttgcagcttttgaacttaaagacagccgcgtaaaggtgattgatcttgcaataaaatacggttatcactcaccagattcttttgcacgagcatttcaaaatctgcatggcataaacccatcagaagttaaacataatggccattcacttaaagcttatccgcgaatgaccttccagttatcaatcaaaggaggaaatgaaatgaactatcgcattgaagaaaaagaggcatttcgcatcgtcggcattaaaaaaagagtccctattttgttcaaaggcgtgaatcctgacattgcatcgatgtgggaaagtttagatgaagcagcaatcaaacaactaaaagagctttctaatacagcgcctgcaggactcatcagtgcatccacgaacttttctgaaggcaggacagaggaaaacggagagcttgatcactatattggcgcagccacaacgaaacattgcccaaatcacctatcacagcttgaagtccctgcctcaacatgggctgtattcgaagcagccggatcatttccggatgcactgcaggaagtatgggggcggatttattccgaatggtttccatcgtcacattatgaacaaattgaaggcccagaaatcctgtggaacgagcataaggatgtaacatcgccatcttttaaaagtgaaatttggatacccatttcaaaaaaggaatatatctgacaatgaaattagaggaattaaaggttttaaggaaggggtcttatcccttcctctttatgtcactaaccccatctgcggcaatattgatgccgctaatcttcgaattgagttttttaatgagcagagccgatcttactgaaaatataaattgaggtgtattgcgttttgatgatctgcttctcacttcttattttccgccttaacatccgatcatttctgcaattcttctgcaaagtctgacgttgatgattgaccgccaagtctcccgttttgattcctgccttcacggtttcccgaagtgagttctctattaattccgctgcttctttccgagaataaatcacttcacaacagacaaactgaaggcggtataaaaaacagctccgttaaaatggccggaactgtctttgacttttggattttgcagttatctccatccgttagtttaattagaattcagataatccaagacacgatcaactctttcattgactgagtaatctccttcaatttttaacaatggacaagataaatccgacatccaatgttcgtgtaaagctttgcttctaacttccattccggaatgatcatataaagaagcccactctaaaaatgtttttgattgttcatatttactgccgccggctaacacttcgtttccataacgctgaaattccctatgccttaatctctcaagccgtatatcctgcggaatccataagaagatgacaaggtcaaaataactttttagatcatcgccccagcggcacactgcgccagaaagaatccatttctcatttattgtcaagtcttttttaagtaactttcttctttcagcgatttctctttttttagtgaatttatctgtccaatagtaatcatcagtatcaagatgcgtatgcggcaaatgctttgataatgcaacacccaatgttgacgttccgacaccagaggctcccaatatgtgaatcttatttttcatacttccccctccttatgaagcaaccaaactccctgttgcataaggtacttactattattttgacataaatccctaaagacctttactttgccaggggaatccagatgcggttaaaaccataccgcttacgaacttcatagtcattttcaaacagtgattaactttctctccggcctattttaatatcctcatacactttttcaaaagtctcgattggcagtgaaaacttggttgttttctcgttacggtaattgattacgattatttttttgttcagactcaataagtgcattctcccatttatctctgattgaaatgatacaattttccatttttcttttcctttttcttataaatgtaattcactttaacgcccctttcattgatcggcaaaaggttccgtaataaggaagctccttaaaaaaaggatcaaaacttttatcaagtttgatccttttccctttttagtcatttcttcgcgaacgtttatagacattcatggttaccagccagctcataacaacgattcctgtaaaaagaatgagcatattactgtacaaataagcggaatgatcatcgttaacaggcagcagcctttgattcagcaagctgatcgataataaaccgcctgcaatcgaaatacccgttccctctgataaaaagctcgtaaaattaagcagactcattccggcgccggcttccttttgtttcaaactgccagacacaattgtagatataaccgtttttgtgaaggagagccccccaaacacaaaaacgattatgacggtcataagccaaggtgccgcatctatgaaaaaggcagcgattaaaaagctggaagacatcaatacaatcccaatggtcagcacacacaaagaacctttccgatcaacaagcaatcctccaatgtaaccgaagatgatgacgctcatcgtcccggggaacataatcccgcttccaattgccgcagtacttaaatggtgaacatctttcatcatataaggaaccatagacacaaatcctgcagcagtgccgaatatcaggcctccgctaaggacgcccgtcataaacaaaacatttttccccagtgcagggtcaacaaagggatcttgagttttcctaatatgtttcacaaatatcaggaaagccagaatactgatgatcagaaaagacattctatatgacgttgtaaacagcagaaaaaatacggtgcctgcagacattaatataatccccgtcatatcaaagcgcccgctgattctttcttccttttccagcagtttcatcaggaatggaacggtgataactgttgctgtcggaataagcagcaaatatgaccagtgaatataatgagcgatcattccgccgatagctggtccgacaccttcccccattgccaccagcgacccgatcagaccaaatgctttacccctgttttctttcggaatatagcgtactactgcaaccatcacaagagccgggaatgcggctgcaccagccccttgaataaatcgggccagaatgagtacaggaaagaaagagtgtccgacaaatccaatgatcgatccgaagccatttaccataattccaaataggagcagttttttgatgcccagctgatctgataacttcccatacagagcagttccgatggaaaatgttaacataaaagccgtgttcacccagtttgcactcgctggcagtttatgaaaatcgttggcgatatcaggtaacgagacgttcaaaaccatttcatttaatacgctgaaaaatgacaaaacacaaagccaaatgaacacttggttgtgccgtaaagctgactgtgaataaggcgtattcacaaatttccctccattaatgagggcagacgcagtttatagggccattgatacgcttccctcttttaattgtaccctgttcatttttttgcacttcatacataactccccctgcattgattgatataccttattataaatcctcaagccgatgttttgaatactttgcggcacacacccgctaaatgacgaaacatcaaatactgttatatttaaaatttacagtaccaaaaaaccgcaatttcatttgctgttgaaaaattggaataaagcattgtatcgaccgctcctatgacaaagttatttttggcataaaaatgacaagctgaaacattaatatcttgtgtttcaagcataagaccgcataaatgattctcctttgcccactcaatcgctttatgtaataaagccgtcccgacaccattttttctataatcttttgcaacggcaatgtcttcaatcagtgcgtatccattccaattagaacgaagcttactccggccgacacagtcgttctctgcgtaataaaaaaagacaactttatcctcttcttcagcataactgacatcaatgtcttcatcgtcatattttttgacataaggttcagcaaatttctcctctgtatatgtccaaacattgttttcaaatgaagggatgattctccctgaaacaacgaaaggttcgtttggtttattgaagtctttcatattgaattgagtcattttagttatcatcataatcgcctttctgcagttattgaactcactttacaccttttgaactgttgattcgtctgcatgtcacgaagactaatacaaaaaagataccaacattgattggtatcatctattcgttcgagcccttacaacaacatcctatttcggagcttccaaaccaaatgttgtccattcctcttttgccggaccataaatacccggaacaggtaaacctgcttgtctcataaggacagtcatttgtcctcgatgatggttttgatgttgaattaaaaacatcaaaagtgaaccattcggcaattgctgaccaataaagttgacacattcttgaagtgtatcgtcagtccattgcgtttttaacgcctgcacaaatgcattactggcttgatgataactctcagcaataaaccgcgccgatgcaggaacaggataatcttcagccggagcgtggaacgttaaatctgtgttcgaggtaatgatatgaatggccgcgacagtatgccatgcaatacggcctaaagtccaatgttgtgaagtgatttcttgtttaagtgattcatcagtcagatgattcagcagtttttgtgtcgcatcggcttcgaattcccaagatttcaaaaaatggtctaaggtttgaaacataaaaatcctccttatccttttttgtgtttctatatatctgcagttcaattatagcgctccgtttagttaaaaaagaacaaaacgatacacagacaatacaataacagacaaaatataagaacataacagatcactctatacttccttttcttcaatcggcaaaaaaggatagctgttcaaacaggattcttctgtgtctaatattttcgctttacaaaagtccataccgtcttagtgattgaaccggagataaaacagctccccgtcatcatagccacccaaatgaaaaatgtcggttcggcacctattacaataaacataaatatcaaggacaaaatgaatacaataacaaccatcatccatacttttttgaagatgaaatatcctaaaatccctaacagaaaagaagctgctggaagaaaaatgagaatgatatacgcgggactcaacagcgggctaatacaaacacctcccaatttcaaaacgaggaagttcctactttttgtctgatatcaaatgatatgaagtgatttatttcatcttgatattacgccgtttcattcattttatacatattataccaatacaattgggtcaaatatagatatttattcatttttaacatattttcggaaaatcaggagtgatttaaagtcggaggatagcccgctttttcttttcctagtaagtcctgccgcattggctttagcccatctgctttctcattgtttttgcagcgctaatattctcataatcgtgtgcatgacgctgctttcgtcatttgatttgatgacaaagtgcgccgcatcttttatttcgtcaatggcgttcttaaccgcaaagctgtaggaagccgcttccatcaattctttgtcattgcggccgtctccgaatgccattgtttcatcagccgaaacccctaataatcgctgcagttcttgtactgttgatcctttatgtattccgatatttgatatgtccatccaggtatcttctgatgctacgatatataattggtgaaaaaattcatgcagcttttctctcgtttccggacagttggcgtcggggtcatgaaccgtaatcttgataaaatcgtcttttatctcagtaaaatcagttattttcgttacatgtgcataagaggcatttacatatttcatttcactttcagacagattttcttttacgatcgcgcctttttttgtgcacgcgataatggtgtgcccgcagctgattttttctaaagcgcctataattgacagtccggctttattgctgatcaaagattcatatacgaatttgccgttctttttcatacgtgcggcactgtctcctaaaatccaaaaatctttcgcgtcttctccgaataaggcttccaccctttcacactgtttcccggtgcagatggcgaaagcgacatgctgttcttccattactcgttttgtcttttcaaataacgttctgtcaaaatcgccttgattatttaaaaatgtgccgtctaaatccgtaatcactaatttaatcatcgttcagcacctccgcagttaaaatgtctttttcagacaaagggtttttcacatttgagaatggaatcaatcgcgtttaagaccccttcctcattgtttgattgcgcgatatgcgccgcggcctgtttaatgctttcctgcgcattatccatagcgactccgtatttcacggcagacaccatctccaaatcattgccgctgtctccgaaggccgcacattcttcatcatttatcccccattgtttctggagaagcctaatcccgcttgctttatgaagccccggtatgatcagatctatgtcaccgtgcccgcttgatacaggcgtgacgaaagacccgatggcgtcttttaaatgcctcagaagtgcggaacaatgttcggcgggaaaactgatggaaaattttaaaatgtcatcatcgatgttttcaaaatgcggcaccctttttaacacataataatacttactggcatgcagatattcatcctcactggcattttcatgaatatacgcgcttttttttccgcagacaatgacgtttttcacctcatactgctctaaagcacggatcacctcttttatagtgtcttcagacatgttacccgcgaataattcttctccggcattcacgacgaaagcgccattctcggcaacgaaagcgatttcacttttgatttccggaaagaaggatgtaagctgcgcatattggtttccgcttgctacggcaaatttaattccccgcgcttttaattcacgatactgattcataaaacgctctttgttatatgccatttcatcattcaaaaacgttccgtccatatcaaccgctatcagtttgatactcatattgtcctccttttttcgaccgcttttgtcagagacccttgaagagatcatgcataagcgtatgaacgaattatatccgcagttgttttgcaccgtaaatcattggctgacgtcttgttttgaatgacacaaaaagtgatttgtcacataaatataacactatgtttcttttaaaaatgatatgttacgatgagatgtacattcaccattctcataaaaaggagaatccccctgcatgttcacacacgaaatgattgcttcatttaacgagcttgaaacttctttatacaactacatctcccaaaacagcgagaaagtcgtctatatgcgaatccgtgaattggcaaatgaaacccatgtatcgacggcttctattttacgtttctgcaaaaaaataaactgtgaagggttttcggagtttaaggtgaagctgaaaatgtatgcggaggcaaataaaaaaacgattttaaagagtccccatcattccgttgccgagttttttgaaagaacagtaagcggagggatggaagaaaagctgaaggaagcagcagcccttgcagccgatgcagaaagcgtcatttttatcggagtgggtagttcaggaattctcgccgaatacggagccagatatttttcgtgcttagggaaactttcaatgtatattaaagatccttactttccggcccattcccatttccgccataacagcatcacgatcgcattatcggtttcaggtgaaggagattctacggtgactcatctgaatcagctgaaacaagaaggaagccgggtcatcagtattacaaatcataaacattcaaccattgccaaaatgtctgatgtgaatatttcatattacgtgacggaagaatgggttgaaaatgcgaatatcaccacccaaatccccgctatgtacatacttgaatcaatggctcgggagatatacaaattgagagattaaattcaggaacggaccacggaaatttcggcctttttgtaaaagtgatgaaaaacccttctctgctgccagagaagggttttgaagattacagatgagacacaatacactttgcatggcccgccagtttatattctcccaaaccggaaggcaggagaatgtgatctccttttctaaagggatgttcatgcccgcctgcaattattattccgtctccttcgatcacgctgacaagaaggaagggatgattctggaataaattcgcttcaccttttacatcccacttttcgactgaaaaataaggacattctattaaaacagctgccagcagatcatctgtttgtttatattgaacggtcggccgttcacggacagatggaacgtctgtcacttctatacttttttccaaatggagctcgcgcagcctgccgtccgcatcttttcttccgtaatcatacaatctgtaagtcgtatctgaattttgctgcgtctctaaaataagtgtgccctttccaatcgcgtgaacggtgccgcttgggacaaagaagaaatctcccggctttaccttaactctgttcagaagtccgtcccattctccgcgctcaatcatggatatcagttcttcttttgttgttgcgctgtggccgaaaatgatctccgcatctttttcacaatcaatgatataccagcattcggtttttccaagttccccgttttcatgcattttggcaaagtcatcatccggatgcacctgaacggacagatcttggtccgcatccaaaatttttgtaagaagaggaaaacggtctccttcaaggtttccgaataaatctctgtgatgctcccacaattcaccgagcgtacatcctttatacatgccgtttcgaactgtgctctgtccattttgatgagcggcaaaggcccagcactcccctgtccgctcggacggaatattatagtggaaatcacgcagggcggcgcctccccaaattctttctttgaaaaccggattgaaaaatatcggttcagtagacatgatcatcccccgctttattcgatttcttccagaagcccatacgcctcttcttttgtctgaacggagagcagcctttcccgatagctgtcatccatcagttttcgggataacatctgcaatattttcagatgctgatttccgccgctttccttcggtacggcaatcataaaaatcagttttgcatcagaaccatcaaggctgttccagtcaacacccgaacgtcttattccgaatgcgacacccggcgttctgacggcatcagactttccgtgcggaatggcgatattcatacctatcgccgtggttccctgctgttcacggctcaaaatggcctgtttaaatccgctgtcagacagaagcatacctttacgggacaatttctcgatcatttcatcgataatgtcatccctcgtttcgccggataaatgcggttcaatcaagtccgtgctgataatgtcagtcagttttttgatttcggtcatcccggcttttcggctgtcagcctgagatggttcctttgtttcttttgccgctgcagcttcatttggtgcggcagacggcagcacctcaccgggcgcgggggatttcgccatatctttcttcagtacattaaccaacagagcggtgacaagagagcctgctgttacagcgataaaaaacatcaatacatgatctactgctccaagtacagcaacgatggggccgccgtgtgccactctgtcccccacatggccgatcatcgctatcaccgagccggtcatagaacccgccataatactcgggatcacacgaaggggatcttgggccgcaaatggaatggctccttccgtgataccgaaaaggcccatcgtaaatgacgcttttcccatttctttttctgcggcggcgaattttctttttcctaaaaacgtcgcaatcccaagccctatcggcggtatacaaatggaaacggcaatcgggcccataatttcataatttccttctccgatcattgccgatccgaatagaaaggccaccttgtttacgggtcctcccatatcaaaggagatcatcgctcctaaaatcaatgccaggagaattgagctcgagcctttcattcccgcaagccaaaccgttaatgatgcgaaaatatgagcgacgggggcgccgatcagaaatacaaacgccaaaccgacgatcagtgaggcaaacaccggaataataatgatcggcataatcggctgtattgctttaggaactttacattttttgattccaagcgccgcatatcccgccaaaaatcccgcaatgattcctccaagaaatcctgcgccgctcgcactgtcgtaaaagctgccggatgccgcaatatatccgccgatcattccggggacaagacccggcttatcggcgatgctgaacgcgatgtacccggctaaaatcgggatcatgaatgaaaaagaagcgctgccgatctgttcaatcgttttccaaaaagacgcatccggaatgactaagccctttggtgttttttctcctccaagcgtcaatgcaaccgctatcaataatccgccgacgacaatgaaaggaaccataaaagaaacgccgttcattaaatgacggtaaatcgggttttgttttttgccctgctgacttgcggattcagtttttgaagcagattgatagaccggcacttcaccgctaagcgctctttgaattaattcttccggtttgcggatgccttcctgaaccccgacggccagcagcttttttcccgcgaatcggtctttgttcaccgaacggtccgccgcgataatgattgcgtctgcttcccggatttcctcttcggtcagcctattttccaccccgattccgccctgggtttccactttgatctcaacgcctaatctgccggctgctttttgtaaattttcagcagccatatacgtatgggcaatgccgttcggacatgatgtaatcgctaacagtttcatataaatcctcctttgcagtctgaatttcaagatcttgtctcaactttatactgaaatcagcctgtgataagcgcgtttttttaccataagttccggaaataacggcatttttccctataaacagaaaaaaagcagggagccatcccctgcttttaatagtttaaatacgataaaaacgtcatcacatttttttcttccgtcagtttttgaataaatgccggctgctcgctaagataggaaagctcactgaataattgctttaccttgttttgatcttcgtgtttgacggcaagcataaatacaagcgacaccttttccgtcccccactcaatgggctcttttaaggtggcgattgcaatggctgattgtttgatatatttagagttcgcgtgagggatggcaatacccgccccgatatttgtcgccgacattttttctctcattactgcatgaatgccatactctttttctacatagcctttttcatacaaagcctgcgccagcttttcaatgacctgataacggtgctctgtctcttgctgtaaaaaaacgagaaacggagtcgtatcattcagcattttaaacgttttttgctcccggcggtgtgatgtatcaagctgttgcataaatgcgctgagcttcttttcatcagcaggctccaaaagcggtgatacgacgatatgagggatcgttacatttccaagccctatcgtagaaatgacgaaatctatatctttatgctttttgatatactctgtcagttccgcttttgcgatacagtcttttatcgtaatgtgatgaaatttgcgttcaattttagtccgcagcaattgcgacatgccaatgcccatatggcagacgatgatcgtccttttagggttatgactgcttcggcgcagccgttcgatcgctgcctgaaaatgcagggtcaaataggccgcctcttcttcaggaatataaagatcaaatgtttgattgatgtcttctaaaacgtcaatgataagatgaaacaaataaggatacatttttttgatgtcgtggagcatggggtttgaaacagagagatcatagctcagccgcttcaacaccggatcgagatgaatgttcaatccattgatcaattcctggtctttatggaaatccagcattttcagttctgaaacgcgattgatcaaatgcctgacgactttggaaagctcagaatcttcaagatcaagcttcttttcttgctgcaatggatagcgcactttcccgcctattatatgtaaagttaaatagacggcttcttcctcgggaaaccggatggcaaataccggctcaagccgttttaaacaagccagtgtccattcatattctttcttcttttttaccgcctccagctgccttgcagagatggcgaccggctgtttcattttgatacggcggatggtcagcaatgtatgcagcagcaaactttcaaatgtttcatccgtaaaatagatagaatggtttttttgtaataacttgatttcttttctcacaaagtccgcttcatgacttaaaaacttactttttataaattggcttgtaaactccgcattatcaatcaaatctgaaattcgcgccaatgcttttcttttgtttttttcgtccccttcaatctttaagccgagccgctgtttagaaaccagtgtgagatcaaatcgcttcagccactcttcaaccgcactgatatcctttttaatggaagctctgtttacaaaatgctgtgcggcaatttcttttgcggaaacgggctttgaattcattaataaatcataagcgatgtgaagtattctttcttcatcggtcttgtgcctgcatgtaaagtgctcattataaatgtgccggcttaaccgtgatctttcctgttcagatatatgtaaatagacgcctaatcccggtttacggatcagctgagcttgagcatgttcattcaggaaatcttcaatcgttttcaaatcattcctgatcgttttttcagaacagcggaccctgtctgcgaaatcttgcacaactaagtagtcatcaggttcagataacaacagatacaaaatctttttctgtcttgaattcatgtatttcatctgtttttctatccttcctgtccgtttctgctggagcaattgtgataggttaaatataccgcgcatacgaaaccgttttcattgtatagtgaaacaaaagagtaaaaagttttgttttttaccgcagattccggaaaaatcatgttttatactgaggctgttcacctttggttgacaacaaaacaccaaccgtttttaaacgattggtgtcggcagcgaaaacctgctgttacagccaaaatgtttcgccaagcgctaatgctctcaggttttcaggaggtaatgcaagccggtcccactcaccgtgcagtctgcttaatgcttccgggcctgtatcatcagcaagccggaatgccccgtaatgcatgggaatgaagctgtcagccttcagctctaaaaaagctttcacggcgtcttccggattgatatgtgacactttcataaaccattcgggttcgtatgctccgatcggcatcagggccgccttaatacgaaacctctctccgatttctttaaagccttcaaaatagcctgtatctcctgcaaaatagatggactcgccgttttcgctttctatgacccagcctccccaatgagaagtatcggtatcccaaagcgttctccgggtccagtgctgggccggaacaaatgatatattcaccccccgcatctcaaaacgaccccaccaattcatttcatgaacctttttgcggcctttttgatgaacagctttttcaatcccgcaggcacgtaaaaatccgggtttcctctcagtttttttatactcggaaaatcaagatggtcataatgcccatgtgagatgagcacggcatcaatgtcaggcagttcgctcaattcatatcccggctctgtcagccgtttttgaaaacccatcctccgcgcccatacagggtcggtcattatgttaagcccctgtatttggatcagaaatgaagaatggccgatccatgttatggcggtttccgtccgattgacggcaacatcacggacatcccttgtgaccgctttcggaatattctcgcttaaatctttacttttttctcttcgttctttcatccatttccacatgtccatgaatccatgttcattcttcacgccattcaagttttcatatctttttttcattatcattctcccttgaaacgtgtattccattagatccaccggacatttatacaatgtctgtaaataccgccccgcttgcttcggctaaatcatgaggcgctacttttagctgcattccgattttccccgcactgacaatcataaacgccagtgtttcagcggatctatcaataaaagtaggaaacctttttttcattccgatcggagagcagccgccgcgtatatagccggtcactcccaaaaggtccttcatggcaatcatttctattttcttctcacctgccgccttcgcagcctttttcagattcagttcttttgcaacgggaacgacaaagacgtaataacgatcagttcctgcagatgccactaaggttttataaacatattcggcagagtatccgattttttgtgaaacggaaagaccgtctgcgggctgtcccccttctgttttgtaacctaatagctcatagggaatgttttgctgctcaatgatacggacagcatttgttttcactgtttttttcgccatggttatcctccgttttctgtatttctttctgctttattttcaacttcgattttaataaaatgaccgctcagttgcgtgctttgtaataatcaagtgcaaactgtttaaaacgctcagcagcgggagagagagcatggttttttaactgggctaacgctatggtgcgttcgcattggtaatctgcaaccgggagaaaaacgaccggaaagtatgaatgctccgcggttttcggcagcactgcagccccaagacccgcggcggtcagccctaatatggttgacacttcctctccttcaaatgcgagatgcgggtgtatattcaaatcccggcacatcagatcaaacatatatctcagcccgtatcccggtttaaatccgacaaaatcctcgtcctgcatctctttcatttgaatgcttttattttctgcaagcgggtggttctcaggaagcaccgcataaagaggctctttctccagcactgtccattgtaaaagctcgctgggaagcggcggggagctgagacagatatccgcatctcccgtttccaccattttgcgaagcgtttcatttgcgccttgatacagccggaaggtcacgtttgggtatagctttttaaattcggcaatcagctgaggcatcaagcgcaacccgagcgtatgaagaaaagatacagatatttcgccgtgctccaggctcatattttttttcacttgttcaacgccttcatttaaagctcgtctcgcttgttttgcttttattaagaactgctctccgtgccttgtcagccggacggcttttgtctctctgtaaaataacggcgcgcctaattcttcttcgagcctgataatcgatcggcttaatgccggctgagaaatcattctttcttttgccgcatttgtgaaatgctgatgagttgccgccgcaatgaagttgtcaatttgatgaagctccattttctccttctcccctttcttcataacctacacgcattaattctatagttattataaattagacacattgaaatgaaaagcgtacgatacatatataaccaacagtgagaaaagagggacattcatgacgtttattcagcctcatacaaaggcttacagaaaggccagcttggcactgtttatcagcggctttgtgacatttgccacgctttacacgacacagccgcttatgcctttgttttcggaagagtttcatatttccgctgcggctgccagcttaactttatccatctcaacagccgttttggcattttcattattggccgctgcttcgttgtctgacggattcggcagaaaaaaattaatggtgctgtcgttaacagccacttctgttttaggtctattaacagcgttcagtccggcttttccggcgcttttggcgatgagggggctgctcggtatttttctggcaggcgttcctgctgtcgctatgacatatgtaggcgaggagtttgatccgaagggcctcgggaaaatgatgggcctgtatatcagcggcacaagcatcgggggaatgagcggcaggctgttaacggggcttctgactgatgtattcggctggcggccggcgcttgccattatcggcattctttctattatattaagctatttgttttggcgttttcttccggctccgcgccattcatctcagcggcatgcgggcgtaaaagcggcatgtaaggaatacggagcggttctacaccgcaaacggctgcttttgttaatatctctgggatttatattaatggggagttttgtgacattatataattatatcggctttcatttaatggcggctccttatcatttgtcacagactgtaatcggttttatttttattgtctatctcgcgggaacgttcagctctgtctatatggggaaaaaagcagatcttttcggaagtgcaaaaatgattaagattgcgatttttgttatgcttgccggcgcagcggtgacacttttgccccagcttgcccttaaaattgcgggcattgccgtgtttaccttcggctttttcggcgcacattcaattgcaagcgcctgggtcggccgagcagccggtgatcagcgcgcgcaagcttcttcattatatctgcttgcatactatatcgggtcaagcgcggccgggtcttgcggcggtttcttttggacgcattttcattggatcggtatcatttcatttatttcggttttgctattgctgtcttatccggttttatttctggcggaattcagaaaaaagggacatagccgcctgcatgtaaatcaataaaaacattaaagatttgtgtcttttgtccgatactaaagataaggccggcacgatactccctataactattccttttgattcagtagatttcaaatatcgtgccggctttcttcaattaaaacacaatcttcaattgccttacgcttctgttacacacctgcccaaacatctttcgcatatcttccttccgcctgcagctgttcaagccaattcgaggaaacttttgaatcagtgttatgcaccttttcatacgcctgaagcagtacattttcgacagccggagccattttgcttccgtctccgcatatatagagatggccgccttggtcaagaagcgcaataatctgtgcagcctcgcgaagcaggacatcctgtacgtaaactttacagtcctgatctaatctggaatacgcccgatgcacggtgacaaggccgtttttctccgcatggtcgaattcatctttgtacagatcgtcttcttcagggtgtctgcagccgaagtataaatgagcttcgcccaggctgttaccggacattttttctgcagcccgcgcctggataaatcccctgaacggtgcaattccggtgcctgctccgatcataatgagaggcgttttcgtaatttcgggcaatgcgaaacccgactgcggcgagcggatgaaacagacggcagaatcgccattttgtaatccggctaaatagttcgaagccacgcccttgtattctccccggccgctccacgccggagccgtcacaacgccgaccgtgatactgagctcccttttgtttgccttcggtgagcttgagattgaataatagcgcgcctttaaggacggcagaagttctaaaaagcgctcaaacggcagttcacacgccggataatcttccagcaggtccagcatggtcattcgttttttcagcacgttttctttatatgccgcatcgtcagaataaagatgctccaattctttttggtgcggcgggcacacggtatgggcggcaagttcgcgaagctgggctctcgttgccggttcctgcagctctacatatgacgccaaaagctccggcgcattaaccggccggtccatcggcagatgaggcagctgccggcccttgatcttaaagtgctgatttgggtcgagaccgaatcggcgaatgacacggctgatcagttccccgctgttttgcggaagcaccccgagatggtctccttcccgatacgtttcggtcttcgggagacgcagctcaatatgccggactgaacgcttgctgctttcggtatgaagctctttgtttgtgatgacttccgcctcaaatgctttgtacgttttggcaatcggcgtctcggctgcttcacttacgtattcgattgataactgtgatttgtttgcctgttttggagcggcctctatatgaaaagccttcatgatgtccttccagaatgagtcttcccaggcttcctgactgtactcaaaatcatcggcattgtcgccctccccgatagaagtcagccgttttgcccctttttcttcaagcactttgtctatcaggcggggtaccctctggtaagtggcggcccagttacggtctccgcagccgaagacggcgtaagaaacaccctttaattcctgatcttcaagggtttccatccatttcacaaaacccgccgcattatcaggcggcgccccgttataagaagccgtcacaataacgactgcgccttttacaggcagtttcccggcataatcatcgagcgggccggtttcagttgaaaatcctttgcttctgccgatgtcagccagctcttccgcgattccttccgcagttcctaaatttgatccgtaaagaatgagaagcggcgttccgtgggacgggatttctttcgtttcttctttgtgaccgccgccttcagctttatggttttgtacgggctgatgattggacacgtccttgttttttacacggattttaaaatcaccgggcttaatggttaaagcttctttaatcgtaagctcataatcagtatgatcaatcagttcaaagtgtttaaggacaaggccgagcaccattgtcgcttcctgcagggcaaactgcatcccgatgcatgcgcgctgtccgtttccgaacggcttatacgcatcagccggaattgccgcgggatcgctgaacctttccggacggaatagctcggcatcttctccccacgcgcttttatcccggtgaagctgcggagtcagaatcgtcaccggctgtcctttcgcaatcggatatttcccgccgagaaccgtatcttctttcgcgtacagggaaaatgccggggcagtcggatacagccgtaaagtctcgttcaacaccatgcgggtatatgtcagctgctgaatctgcttatattcaggtgtctctcccgtcagcacccgctcggcttcctgaacggcttttttcaatttatctttatttttcagcaggcagtaaatcgcgaatgaaagcagtccgcttgtggtttcatgccccgcgatcaaaaaggtaatgatttgatagcggatattttcatcatccagcctttcacccgttacaggatctttcgcttcaagcatcaatgctaaaagatcagacagattctcatccggattttccctccgctcagcgatgatccggtctacgagttcattcatcacttcaatatcctgctggaactgatgtctcgttttgatcatcagcttgtcctgcaggctgtgtctctgtgattggcgcattgcctcctgcagcgcgcgaagcatacttgtgataaaaggatgctgtgtgtcgcggtaaaagctgttaaagcggtaatgaaatccgcacaggccgattgtatccagcgtcaggcgcgtcatatcttcggcaacgtcaatttcttcattcggatttaatctgctccacttctgcacaagctgcatggcaatatcaagcatcattgaatgatagcctttcatcgccttctggctgaagctcggcaataaaatccgatgcgctttctgccaattcttttcgtgagtccagctcgtaaatagtccgtcaccgccaaactcacggactttcagcaaggctttgctgaggtttttatcaaatcgcttttcatcacagacttctgccgcgagctcgcggcctgagacgaagaccccgacagagctcggaaattcgaaacgaaagatcgggccgtattcttcggcaattttccagagcgattgtgacagtttttctttttccaagtgagggagatttttcagaggtccgtatgttttcggctgcggtatagcgcttagctgtttcatatcgatcttccttccttcggcgaatagttaatgagttctgatggcatcccaagaacattgttccaattctttcagaaacggttttgttatttcgacgcttcccgtccggataagctgatagagtttgagatatgccccgagcagcagcgccatcagcacattggacggcagattgcggagcacaccttcagacttgccgcgctgaaaaaagacgtcaagcatctgtgttatttcatcaagaagcttacggctcgtttcattcagaaagtaggcgtccttattcgtttcaagaaaaaacaatgcatactcactttccttcgtaaaatcaatcagacaataaaacaggtgatgaaacccttctcttacagagataccctgaaagtccgttttgacttttttcataaaacgctgcgcactttcctgatacagtacgttcacaagtgtctctttactgtcaaagtaacggtagattgtgccggttccgacatcggcctgagcggcaatcatcggaatcgtcgttgcgtcaaatcctctatctgtaaacaaagtaagcgacgctttcataatgagttcaaccttgtttgaagctgtcatttcatccccctttccagatgcggaatgaatattcattccgtttgttcaaaacatttaaaatgtacggtcatctgattaccattgtataagaaaaaaactttttttaatataaaatagatgtgaaataaccaaaaataaggaaatatgcccaatttcacaaaaagagctgcagtgacttaagcagctctttttatttcccaagaaatattctatttaatggcagtaataaaatggaatgaatctctgctgacaactgaaatgtctctgaaatgctgatcatagagcacctcaatcacatccttctcactcatccgcgaaggtttcaaaaccatatagaaacacccgtcaatttgaagaacgcggtacacttctttacatgctgtcctgtaatcgctgactgtttcagcagtatgtaatgagaaaactttatgaaagctgcgatcgcggaacggtaagctttcaggcctcccctgctgaatgtttccgcgcccggcttttataaccgaacggtttgcgcgctgtgttttccgtattttacgtttcgatgtttctatgcttttaagactgcccttttcaagctgtccgatgatttgtttaaacattgagccgtttccggtcccgatttccaaaatgcggtcgtattcctgtatgtccatcaagatttgctgaatgactgactctgccagttctgatgcagcaaagtatttcgcgcgcattcgttttaatgctgaagatgtatgttgcaacattgtataacacccgcttttccattcctgtgatttattattcagaaataatattacctcgtattagtatgaggtactaactagacgcacttctcttcatgaacgtttcgatttatttgaaatttatatttgttttcataaaaaaaagacggaaaacgtaggttttccgcctgctctagtaccaataatacggtgctatatatcttgtctgccgggaaagcgccgccattctctgccggcgatacgggttgccgtagccgtgtttaaatgaatggggcattgacgcatacccgtgcccgatggatggaattctgttctgaccgccttgcatgctatcacccgcttaccaatttttctttctttaccatggtatgcaggccgtctgcgacgtgacagcaacatcctcgctaaacctggtccttctccattgtgtaatgattcagcagttcaattctgaacatgatgatctcctccttctcctccgttttggcccttcgtgtccgttcagttcatataaaagtgtttcagctggcgttctttcgcttcattataaaactcttcgacctgctgttctcgttcatactcttccgcacttttaaaacgctttgaaatggtcagtgttaaaaagaaaagattaatggtcattatcgctcaccccctttcaatatccgcacaagcgaaaataacccgcagcaaacttcatatgcgctgcgggcagactaaatccgcagacaaaagaagacgtgcttctttccctgcggggagctgcgaatgtcctgatactccgaaattaacgtgcttgacgggcagaggttaaggaaggacacgaactcttccacaggctgaatcggttcaattgtaaattttgattgccgtttaaagtcgtcatgtgattcaacctccctttgcttttttcttactttgtaagtatatccatcagcttccattttgtaaacatttttttcaagatttggacggaaaatgtgctggcattccgcttcaattgtccttgttttccggcatctttcttacctcaggaaactcttttcatcccttgctttttctgatctttttttgaatatgcaataaaataaataaggccgacaaacactgccccgccgattacattcccgataaaggccggaatgagattgccaatcagatcaccccacgaaaaagaacctgcaaaaatcgcagccgggatgataaacatattggctacaacgtgctgaaaaccaatcgcgacaaacgccataatcggaaaccatatacccgcgatttttccggctccgtcttctgcgccgaaagaaagccagacggccaaacagacaagccagttacagccgatcgccgaaacaataacttttccaaacggcatatccaatttgccttgtgcgaccgcaatcgttttttccaagtaaggtcctgtttcggttaatccgacaacatgtccgaaaaagtaagcgacaaacagtgcgccgacaagattcatcaacgtcacgatcacccaatttttcactaatgcaccggcggatattcttctggaaaaaagcgccatagataccgacatcatattacccgtaatcagctccgcgccggcaagaacgacgagcaccaatccgatgggaaacacggacgccccgattaaactcgacaagcttccccattctttcggaaggtcgccgatgacacggatatcaagcaaataaccgagtgcgataaacgctcctcccaaaaatcctaatacaatcagtgctgaaagcggtgaatgcaccttttttacccctgattcgaccgcaagctccgctatttcgtccggtttacgaaaagccataataacccctccatttatcatttcagccccgcagtttccaaagacgcctaacaaaaaaggcagcattcaaacagcccgtctaaaacgggtttgaatgctgcctaacttgtatgcatacccatacaacaatatcaagcagaatgaaaatatcagctatagaaaatgtacagatcatgcacacattccataaaattcgtccttaagccactgcaggcagttcatatcatatcaaatgtgacaatttcgtgtcaattgaatttttttcagcttttgatttcttcacggcgctcttcaattgttcggtcaaagacaaatacagacaccgcaatattctcttcgatcttgatgtctgaaaacagatgcacgagctttgctccgatgagctcttccattccgtcaggcgtttgttttgaatacagttcctgaattaagctggtccgcgccgcatgaaccatttctcttccttcaggcgtgcgtgcgataaactgctcacttgcgcttagattgccgtaaagcgttgataccgccatgttatccacaaaaacggtgtgaattcgttccggcccctttccaaataattctttgcgcaatttccggataatatcgttaaattcatgaatttttttagacatattgtcccctccgattttagcctatgaaagacattcccggttcccctttgtgacatttcacctggttaaagttttcctttcgtattgtattataataaatatcaccttataataaaagcagtgaagatggatttgtaataggaaacgtgttatgagtctatcgttttatacaaataggattggtctgttagtaagacttgctagtgaactattccgccatgcgtatttataccgttctccggacaggaggccggtatctatgtgcatggctttttttcgagtttaaaagatggaggggaattggaagtgacagacgttcagtctatccgtgtcaaaattgacggcacggagtatgaagcaccagaggggtctaagattttagatattttaaaccaaaacggaattgagattccgcaaatatgccatgtaccggaagtagatccgattcaaacatgtgacacctgtattgttgaagtaaacgggaaattgcagcgctcttgttccacggctgcagaaaacgggatgtccatctcgcttacgtcgggaagggtaaaagaggctcagacagaggccatggaccgcctgctcgagaatcacctgctttactgtacggtatgcgataacaacaacggcaactgcacactgcataatacagcggaaatgatgggaattgagcatcagaaatatccgtatacgccgaaagatgattcaaagtgcgcggttgatatgtctcacccgttttaccgctatgatccgaaccaatgcattgcctgcggccaatgtgtggaagtgtgtcaaaaccttcaggtgaatgagaccctttcaattgattgggagcgcgaccgcccgcgggtcatttgggatgaaggcgtccccattaatgaatcatcctgcgtcagctgcggccaatgtgtcactgtctgcccttgtaacgcactgatggaaaaatcaatgctcggccaagccggatttatgacaggaataaaagaagatgtcatggaaccgatgattgatttagtgaaaaatgttgaacccgactatacaagcatcttcgccgtgtcagaagtggaagcggctatgcgcgataaacggacgaaaaaaacaaaaacagtctgcacgttctgcggcgtcggatgctcttttgaagtatggacaaaaggccgtgacatccttaaaattcagcctgtttccgatgctccggttaatgcgatttccacttgtgtgaaagggaaattcggctgggacttcgtaaattcggaagaacggattacaaaaccgcttatccggaaaaacggcgcatttgttgaatcgtcatgggaagaagctcttgatcttgtcgcttcaagactcggttcgatcaaggccgaacacggaaatggttctgtcggttttatttcttcttctaaaattacgaatgaagacaactacgttattcaaaaattagcgcgtcaagtatttgaaaccaacaacgtggataactgttcacgctactgccagtcaccggcaacggacggcttattccgcacagtcggtatgggcggtgacgccggcacaattaaagatatcgcaaaagcgggcctcgtgctcatcgtcggcgccaatccggcagaaggacatccggttctggccacacgcgtgaaacgtgcacataagctgcacggacaaaaattaattgttgccgatctgcgcagaaatgaaatggctgaacggtccgacctctttatcagcccgaaacaagggactgaccaagtctggctcatggcagtgacaaaatatatgattgaccaaggctggcacgatcaagcgtttattgatgagaatgtcaactactttgaagattataaagaaacgctgaaaaagtatacattagaatatgcggagcgcatcaccggactttctcaggatacgatcatccgcattgccgaaatgattcgtgatgcagacggcacttgtgttctttggggcatgggcgttacccagaatacaggcggctctgatacatcagcggcgatttccaacctgctgcttgccacaggaaactaccgccgtccgggcgccggagcttatccgctgcgggacataacaacgttcaaggcgcttgcgatatgggaactcttccaggctggcttccggggtatcagcatattaccgatgatgcggcacgcgctaaattcgaaaaagcttacggtgttgaaattgacggcaagccgggtcttgataatattgaaatgctccatgcgattgaagaaggaaacatgaaagccatgtatctcgtcggtgaagatatggcgctcgtcgattcaaacgccaaccatgttcatgacattttatccagccttgatttctttgttgtacaggatattttcctttcaagaacggcgcaatacgcggatgtcatcctgcctgcggttccatctcttgaaaaagacggaacatttacaaacacagagcgtcgtgtacaaagattgtatcaggcgcttccgacactcggcgatgccaaacccgactggtggattattcaggaggttgccaatcgtttaggcgctgattggaattacacgcatccaagcgacattttctcagaaatggcgagcctttctccgctgttcggaaaagcaagctacgacgttcttagcggctggaacagcttcctgtggggaagctttacgggagagagcactccgcttctttatgaagacggctttaacttcccggacaaaaaagcccgttttgcgctgagcgattgggtggagcctgccgtattccctgaagaatatgacctgcatattaacaacggacggatgcttgaacatttccacgaaggaaacatgacaaacaagtcaaaaggcattcagtctaaagttccggatgtatttgttgaagtatcgccggagctcgcggctgaacgcggaatttgcgacggaacaatgatccggctcgtctctccttttggggcggttaaattgaatgcgcttgtgacagaccgtgtccgcgcaaatgagctttatctgccgatgaactctacagataaagattctgcgattaatttcctgaccgggcctgcgtatgattcacggacacatacacctgcctataaacagacaaaagtccgcatggaagtgctcggttcctgtgatacaccgccgcttccgaaaacgaatccgcggaacaaaaaacgtcatccgcaaaacggtgtggaagctcagcgaaaatggaaccgtccgggctatgtgcacctaactgattaaggaaaggaggaaacataatggcaagcccaattactgaaattcaaaaagaaacgaaaacagaggaacagctgaaagctgaaaaactggaagaactgaagacgcttctcgcagaaaatgaagaagccgtcgcgaaaacgatgtccattatggcagagctgaatggcttgggcatttttgatgccgccggctatatgctccaggcaaaagaggagattgccaaaatcgcactcggacagatttcccgggaacctgtcaccaatctcctgaatacgatgatggccgcgggaggcgcgctgtcaaaagctgatcccgaatttatgggcagacttttagaaagcgccatggccgggacggaccaggcgcaaagatttttaaaagaggacaggaaagtcagtatgtttgaactgatgaaagccgtcggtgatcctgatattaaccgcgcgctcggcttcgggctgcagtttttaaaaggaatgggaaaagaattacgcgaaaccccttctgaataagaaatgaaaaagccattgtcaaaagacaatggctttttttattcttcggcctcttccagcctctttttataaataagtgaacggtcaacgcagaaataagcgcccgctaaaaatgcacaatccgttacaaacatcagcattttctggcccgcagtcagcccttgtccgggaagaaccgcgccgatataaatgaaggtgctgactgcaagcagaataaatgcgtaatgcttaaaatcttctattaatgatttcagtcttttcttctccatataaggtcacctgccagttttatagtctaccaacattataatacaagctgacagccgacagagaatgtaaatctatccattctttataaaagggaatcaagcgcctgtttcacatccgccgttaaatcctcagtatcctcaataccgactgagatccgtacaagcccgtcggtaatgccaagcgcaagccggcggtcgcgcggaatcgaagcgtgcgtcattctggacggcacggagattaagctttcaaccgctcctaagctttcagcgattgtaaacaggttcaatttttctaaaaacgcgtcgacgcgttcactgctgccgatatcaaaggaaatcattccgccgaaaccggagctttgcgcttttgtcagctcatggcccggatgtttcgctgatcccggatagtagagcgtctgaacggcatcatgcgcttcaagcagctcggcgattttcccggcgctgtgattgatggcatccattctgagtcccagtgttttaatgcctctcattaaaagccatgaatcctgcggtcctaaaacgccgcccgttgagttttgcacgtaatgaagcttttcaccgagctctttatcagccgtcacaactaagccgccgacgacatcgctgtggccgccgagatattttgtcgcgctgtgcagcacgatgtccgcgccaaagctgagcggctgctggaaatacggcgtgtaaaatgtattatcgacgataagcaatacgcccgcttcttttgcgatgtcagacatcagtttgaggtcagtcactttcaatagcgggtttgtcggtgtttcgatataaatggctttcgtattcgggcgaatggcctttttgactttttcttcactgctcgtatcaacaaagtccgcttcaataccgaagcggttcagcacacctgtcatcacccggtaagtgccgccgtatacatcatccgtcaaaataacatgatcgccgctgtcaaacagcatcatgacggcagtaatcgcagccatgcctgagccgaacgcatatcccgccgcgccgccttcaagctccgcaattaagctttcaagcgccgtccgcgtcggattggccgttcttgaatattcataacccgtatgctcgcccgctttcggctgccggtacgtgcttacttgataaatcggtacggaaaccgctcctgttttttcatctcccgtaattcctccgtgcaccatcagcgtttttttcttcatcttactgacctccttgaaaaatgtttttgcttatatatcgatcgctgccgtcagggaaaatagtgacgatatttgatccggcgggcgcttttttcgcttcttcaagcgctgcataaagagccgcccctgaagagcttccgattaagaggccttctttctcggccgcttctctgacaagcgaaaacgccgtatcgtcttccactgtgtaaatggcgtcaaaatggttctcgtccatataatcagggataaactccatgccgatgccttccgttttatgggcatgcggctctcctccgttcaggatcgagccttccggttcaacgatcaccgttttgacggcaggatttttctcctttaaataagctgccgtaccggcaaaggtgccgccggaacccgctcctgcgacaaaggtgtggatatccccgccgagcgcgttccatatttcaggtccgatcgttttatagtaagtcaatggatttactcggtttttaaattgcagaacggcataagaattattaatctctctctccagttcaagcgcttttcgaatggctccctgcataccttcttctctcggcgtatgcacgatgtccgctccgagagctttcataatttgctgcttttctctgctgaaatgctccgggacgcaaaaaacggcgcgaagctgatgctttctggcgcacagagcgagtccgatcccggtgtttccggcagtcgcttcgatgataacaccgcccggtttcacctttcccgtgcgtagcgcatcttcaatgagcattccgcccagcctgtctttaatgcttccgcccggattcatcatctcaagtttagcataaaccgctgttccctccggtatatcaaaatgcttgagacggagcagcggtgtatttccgatcagttctgtaatatctgttatcacgttcaatatatgtcctcctcctggaaaagcggaggagaacgagaatcccccgcttagtgaattcgtttgatgacattcaggacaagctcagttgaatgaacggcagcctgttctaaaaatttatcaaatgaaacgtcagattcttttccggcaatatcagataaagctctgatgacaacaaaaggcgttttgaactggtggcacacctgtgcgacagccgcagcttccatttcaaccgcgtacaaatccgcaaatttggcgcgtacgtcttcaacccgcttcggatcattcataaaagaatctcccgtagcgattgtgcctttggcgacttgaatgccgttcagttcagaaaccgcttcctcagtaatactgatcagcttttcatcagctttgtatgctgccggaagacccggcacctgtccgtattcatagtcaaacgccgtcacatccacgtcatgatggcggacatctgttgagatgacgacgtcgcctacattcaatgtatgatgaaaaccgcccgctgagcctgtgttaatcacataatcaggtttgaaacggtcaagcagaagcgtcgtgctgatcgcggcgttgacttttccgatccccgatttcagcaagataacttcgacgccttcatagctgcccgtcgtaaactcacagtgagcgatcatctcttgttttgcgtctttcagtttgcttcttaaaatcgtaacttcctcttccattgctccgatgactgccagtttcatttatacacaatcccttcgatttaccgtttaatcgcctccattatccagacaaagtcattttgctgcgtaaaccgcgcggcaaatccctcttctgaaaagatgtttttcattgtcccgagtgtcggataatgttccgtctttaaatcgtccgctaattgatgatagccgtttcggattgcttttttaattgtttcatcataagcttcatgatctttaaagacggtatcggcaaacactattttatcatgcttctgaaggattgtgccatattgctttacagccgcttgcttttcttcatcggttaaatgatgaaaggcgtacgagctgacgatggtatctatttgaaaaggcggagcgggaaactccagaaaatctccgtcactgaacacggctttgtcagaaagcttgtcagccgccagttttctcattgacggagacggttctacaccaaacacctttttgttcgcggcggctaatttcgccgttaaattccctgtgcccggtccgaactctaaaacgttagaacccgaaagtgcgacgatgctgtcaagaatattgtcataccctttaaaaacatcagcgtattgtttgtctgccccgtgcactgtggcatcataagtcgctgcccaatcttcaaataatggaataaattcacggcccatatttttcactctccataatttataattcctatgagtatagtatggattaatcgtggaacagttcctatcctatcacaaaaaagaatggaagggtactaaaatactttgggattattgcgcaattacggcagaaaggcttatactttcattgactcagaagaaaaatcaggaggatctgtactgatgaattttcaattggatttaatcaaagataaagtagaatttttcgaagcggcatctttgcaggagcttgaaaagaaaataaacgttcagattgaaaacaaccaggcgattatgcttcgcgtccgttctgtatcccatcaggtgacggccgttgacggcagaatcctttacagcgcgtcggtgcatttttcagctgacgtatgacagaaaaaagcagctgaataatcagctgcttttttgcggttattttaacgtttctacttttgtcggcttccagccttttttgtctttccaagtgatggtgacctgatactttttgccgttcgttttgtctaaaactttacccttcgcatcttgcgggcttccattgtttccgagccacagcactgtcatgtgatcttttgacacgcctgttgcgtaagagatggcgtcaagcatttcggaccagtcttcagagcttgagtcatacgtcgccgcatgttctcccgtctgctttgttccgaccgctttccattttgggttaacaattgttttctcaacatcgcttgatgagccgccctctgttatttttgcgcctttaaaaggatcgcttgaatcagagtcttttttgctgctgtcatcacttttcgatgaatcatcgtcttttttgctgtcagagtctgaagatgaatcagatgtgtccttatcctgtttatcttttttgtcatcgtctgatgccgtatcttttttgctgtcttttatgtcttcatcggatgtctgcttcgtcttgcctgatgcaggtgtttcctgcttctggctcgtgtccgctttttcgctcacgtcgctcgacggactgttgatgaagaggctgactgcaacgacgacaataagaatagatacgatagcaattaaaatgttaagcaccatatttgcttttctgcgcttatcacggttttcaaaacgagattgtttattgctcaatcattctgcactcctttatccctcttgctcagcatatattttaacatgggctgagcggttgttctatgtctgatttgtttcattttcatgtacctttttaacaatatcataaaacactgtatttgtcagagccttatcccccggcgtgtccatgtgcagcaccacgagagcgtatttcggcttgtccgcgggaaagtatcccgcaaaccatttgtggtaaagcgtctgtttttcttttgtgaacattcccgtctgggcagttcccgatttgcctgctatctcatacggcagatcctgaaaccttcggccggttcctttcggtgaggtgacgacttctctgagaattttttgaagctgctgcgccgtatatttgtcgatgttttccccttttaacggctgttctttgaatgacgccatcgtcgttttgtttttgtattcaattttgtccgcgattttgacttgttttttctcaccgccgcgcgcgatcgccgccatcatattggcgacttcaagaggcgtgactttcacgtttttttgcccgatcgccgtctgtgcgacggctttttttacggttttgtctttgtcatctccccaaatgaccccgcttttttcattatacagctgtctgaatccgtcttcccggtacagcttgccttcccagcccgcccgctgtgtgagacctagtttctccgccatgttttcaataacggaatcatcttttttgattaatttttccgcaagacttgtaaacgtataattgcagctttgggcaaagctttctccaaaactgagcgtgcctttatcatcccccggctctccgtacaggttgagattgcagttaaaggatgtgcccggcttcacttcgttttgttctattgcggctgcggcgatcaccgttttaaacactgatcccggataaatcggcgtcagcatgtaattttgcagtgtctgctgctttgacatgtcggcgtcaggctttgataccattccgagcacactgcttttttcaatgtctaaaaggacggctccccccttttttaacccgcggtctttcaatacatcttccattgctttttgaatattgcggtcgatggaggttttgacttgcagcggataaaacgcgtttgcttcagccgtatatttgacgtccattccgaataaagggtttccccttccgtcgacatgatacaaaagttttgtgtcctgatccgccagtaaaaactcatcaaatgtccgctccatcccgcttgtcccgatttttgccgtgatcggcagttccttcctgccggggtatttctttttcaaaagctcagggtcctggtttgtcgcgcccaacagatgagcggctatgtttgtttctttgctgtctttcatatatacgccgtaaatgccgggatatttcaaagaattgatatttgccacggattgtttcgtcaaatgttttatttttctgctgttcaggatcaccggtttttttgcttccgtcagcagctgcctgagctccccctgtttcattccgagaatgtctgatacccggtcaaccggccaatcctgcgtcacgagaaagggaaacagtatgacggcaggctgcttttttccggtcagttctttgccgttccgatcaagaaaagagccgcggccgtctgaaataaggacttcttccgtccgctgcttgacgctttcctgaatcagattaatattggattttgaaaaagattctgtaaaaaacagctgaatttcagccagccttgcaagcagaaagaaaaacacgagcagaaaacaaatcacggccgttttcagcctttttgatacgatcataaaaaacacctcatccacattttggacgaggtgtttcattgttaaacggatcttatgaaattttcacaattttcacgagcatttctccgcccggcgtctgaactgtcacttcttcgtccacttttctgccgagcaggctttttgcgattggcgagtcgtttgagatttttccttcaaacggatcagcttcagcgcttccgacaatcgtgtaagattcttcttcaccgtcgggcaattcgatgaatgatacggtttttcccaaaccgactacatttgaaccgccgtcgtcctcgatgattttcgcattgcggatcatgttttcaagcgtcgtgatgcgcccttccacaaatgcctgttcttcttttgcggaatcatactcagagttctctgacagatctccgaagcttcttgcgattttaatgcgctctactacttctttacgtttaaccgttttcaattgctctaattcttgttcaagtttttgttttccttcgtgagtcatcggaaaaactttttcttgtgccatgttccttcactccttggtggttgtccctcaacaataacgtgtgattatgtatgagagcataaacgaaaaaatcaagaatgagaacacagggcagtcctcgttcttctctcccatataggtactgtttatcttaaactgaatgtgtgttttctgcaaatgtttcggtttataaacagggaaagaagggaactgtctcattcccttccagcctatacataatatggtctgagttatttatgtctatgctatggtattacaaaattgcattttgttcaaggatcgtttgaatcttcgtgaccatcagatcaattgcgacgtggttttgtccgccttccggaataatgatgtccgcgtagcgtttcgtcggttcaacaaactgattgtgcatcggtctgacgacggacacatactgctcaatgacagaatcgattgaacggcctctttcgttaatatctctcataatccgtctgatgatacggagatccgcgtccgtgtcgacataaagtttcatatccatgaggtcgcgaagtcttttatcttcgagaacgagaatgccttccagaataatgacatccttcggctcaaccggaatggtttcctcagaacgcgtatgcagtttataatcataaatcggcttttctatcggccggtaattcaaaagctcttgaatatgctcgattaaatagtcattatcaaatgcgagcgggtgatcatagtttgtgttcagcctttcttcaaacggaagatggctttggtctttataataaaggtcttgctggatcattaaaatcgagtgtcctttaaactgttcatagatggaacgggtgacgcttgtttttcctgatccggaacctcctgcgatgcctataactacaggactcttacccattggtgattacttcccctttctcatcatgttgctcggataaatctttttgtctactttaaatctaacgatttgcaggggatggcgggcagcatcaagctcgtttccgtcttcgtcccaaatagtgccgattgtgaatgtgaaattgtcgatttcaggaccgaaaaattccacttcgtcaccttgtttaaagaaattgcgctgctggagcgtcaccatttgagtttcctcgtcatacgcgagcacgagaccggcaaaatcaaatgttgttttctttccgtgttcgccgaacatctgctcttcatacccgggcgtgccttcaaagaaagcaggcgcggtatcccggtttgcacatttgtccagctcatccagccattctttttgaatgacaaagttttcaggatcagcgcagtatgcgtcgatgactttgcgatacacgctgacaaccgtcgcaacgtaatgaatcgatttcatccggccttcaattttcaggctgtcgatacccatctcaatcatttgcggaatggattcaatcaattttaaatctttcgggctcatcgcaaacggagcgtcttcttcgtcataaagcgcgaccgcgtttgcaccgtctgtctgatacaggtcataatcccagcggcaggactgacagcagccgccgcggttggaatcccgggctgtcatgtgattgctcagcacgcatcgtcctgaataagcgatacacatggcgccgtggataaaggtttcgatttcaatgtccaccttttccttcatttctttaatttccagtccgctcgtttcacgggcaagcaccacgcggtcaagcccttcttctttccagaactgcaccgctttccagttggaaagggactgctgtgtgctgaggtgaatttctacgtccggggccactctccggcatgtttcaataatcagcggatcagcgacgataattccggcaacttttgcgtctcccaacgcttttaagtattcttccagaccgtccatattttcattatgggcgaaaatgtttgttgtcacatatatttttgccccgtattttttggcaaattctacgccctctgcaatttcttctattgagaagttatccgcatttgagcggagtccgtattcctgtcctccgataaaaaccgcgtccgctccgtaatgaacggcaatttttaatttttcaaggtttcctgccggagcaaggagttcaggttttttcgtaatgacgcgttttccgtttacgactttggaaatggtttgatttacggctgtcatccgttgcaccctcctttttaatagaccgtttctttaaagaagaatcctgtgtcgatgcttctgttcacaggctgaatgctttcaatccgctctatccagctctcttttttctcttcgtatgtctctcggctttcgaagcacagatcgattgcttctctgtacatgcgggtcacttcagttaagtattcaggagacttcaaaactccgtcgattttgaaagaatcgatgccggcgtccatcaggtcctctaattcatcaatcatgcacacatcgttcgggctcatgatgtgcgtgccgttttcatcttcaaaaatcgggtatttattgccccgttccttgtcatgcagaaacattcccgcttcttttttcttctgttcgatgtccatgacttttccctggtattcgaagtaatggcccactaaagaacgctttgattggaacatgcacgtcatgccgtggatttgaatttcaatttcaacttcggcgttttcttttatgtcaatgatgctgtccatatttaattccttagccagcactgcccgccgtgcgcctttgcgtccccagtaattgcaggaatagtagttggtacccgttgtttccgtgctccagtgcagtttaagatcgggagccgcttcacgcgccgccattaaaacggccggatcaccgaaaacagccgcatcaacgccggcctcctgcaaaaaggcaagatagccgttcagctcgtccactttttcgttgtgaaaaatagcattgacggcggcgtacactttcgcgccttcctgatgagctgtctttacggcttcttttatatcttctcttgaaaattcaccggccagtctcaggccgtatctctgttctccgactaacagggccgttgcgcccgcttgaatgagcggaagaatatcctgtacagaagtcggagtcaccaaaagttcaggttttttcatgatcattcacctcttctttttactgatggcgatgccgtctccgaccggcagtatgaccgtttgatagtcaggccggttcatcagccattggttatattgatcaattttttcaacaagcttccgtcttcttttcggctcaatgtccgagtgattttgtgccaccagtcctttaaacagaacattgtctgtaaaaatgactccatccggcgcaagcatcggttcatagagctcaaaaaagttcgtgtactggcctttggccgcgtcgataaaaatggcatcataaggagccgtgacacggacagactcagaaagttccagcgcatccccgtgcattacgtgaacccggttttccatttcaaagtcttttatattgttcacagcttcttcatagcgtttgtcgtcccgttcaatcgtgtaaatattcgcatccggaagctcaagcgccatccgtatggcggaatatccgattgccgcgccgatttccaaaatgtttttcgcctgttgaatcgacagcatttgaagcagcacttcaatgcccgcttcttccataatcggaacatggtgctcttttgcataggcttcaagctttttcactttatcaggccgaggcttcagcatcgcgtttatatactcgtttatttgttcataccgatcattcacggcaaacagcctccgttctaaaaaggagtgcccctgacgaatccgcggggacactctcttaagacacttctttatccataagtaaacaacccgatatattttatcataaaacctttcagaatggaataaaaggagagcttttgccctccttttattcgctgtcttttttggaaatatacttttccttcgctttattatggtcttttaatgttttggtgaaaacgacctcgccgtttggttttgcaaggaaatagagataatccgttttgtcagggcggagagccgcttcccatgatgaatcaccggcatttgcaatcggtcccggcggcagccccttatgtttatacgtattaaacggagaatcaattttcaggtctttgtagtagacccggcttttatgcttaccggccgcatataataccgtcgggtcagtctgcagcggcattttttctgcaagcctgttgtaaaaaacgctggcgattttgtgacggtcggctttggcggtggcttcttcttcaataagcgatgccatcgtcagcgcgttatggacggaaagtttctttttttccagttcagatttatacgtttcgatacgggtatttgtttcctgaaccattgccgtcaaaatcgtgtcaagcgatgcatccggatcattaaacggatatgtggccggatacagatagccttcgagcggatgcttgagcttcttgtttgaaagtgcgtccgttattgtatcaggaaactgttttttcagtttgccgatgaatgttttgtcatccagttttgccatgatctcttcttttgaatatgatgtttcttttgcgatcgcatccgcaatctgtgtaagctgttttccttcaggaacggagatctgaaaggcatatcccgttgatcccgcggtcagttttttgataatcgcatccgcatccattcctttattcaggtggtaaaatcccgcctgaaacccggaagcgcctttatacttcacatacagctgaaatgcttttttgcttttgatgacatgctgatcctcaagaatttcagcgattgccgaaacggaagaaccgctcggaatattaatattgactgccgttttgctgcctttgtcaaccggggacagcagagattttccatagaaaaaagcaccgcaaatgatgataagcagagcgatcacggaggacagtattatcgttgtttttttgtttttacgcggaaatgaatttttagtctgattgatattcatacaagtattttcctcccaacagctcttatactacatgattcatgtgcattcggcaatttattacaaaaaaaagccgaagcgcatatgcgctccggctttttccgttcattttattcttcgtcttcttccgctaaaaacgtgttcagcgtttcttcgatcatttcccactcttcatcggtttcaatcggcatcagttcgccgtcttcaccgttttcgttcggttcgaagcttgaagcgtgaatttcaatttcatcatcgtcttgagcatcaatcggataataaagtacgtaagatttgttgaatgtgtcgttttcaaatgtgaacagcacttcgcaaagctgttcgttgccttgatcatcgacaattgtaatatgtttttcgccgtgttccatttctttcacctcttagtttaaactgtccagatatccttgaaggatcatgacagccgccattttatcaatgactttttttcgtttttgcctgctgacgtcagccgcgatcagcattttttcagccgccatcgtcgtcagacgctcgtcccacagcacaacagggacattgtacgctgtttcaagcagtttcgcaaatgtttggctggcttcgcctctcggaccgatcgtcccgttcatgtttttcggaaaaccgagcacgatcttctctacattatagtctttcatcagctcggataaacggtccagaccgtaatctccttcagcctcgtttatttttatcgtctcaatgccctgagcggtccagcccatttcatcgcttaaagctacgccgagtgttttcgttccaagatcaagtcccaatattctcatgaatgtatttacgcctctttatgctgttctagataggattttaccaattcctcgattaattcgtcacgttccagtttgcgaattaagttccgggcgtcgcgatgcctaggaatgtatgcaggatctccagacagcaagtatccgacaatctggttgataggattgtaccccttttcctgaagcgcatcatataccgtaatcagcacttcttcgacgtttgtttcagcagaatcatcggagaaattaaatttcatcgttttatcaaacgagctcaccgttttgcacctctttcccaaattcgcaggcaaagttcagcctgaggtcctcatcttatcatcattctacactagttgaaaggattataaaacggattttatccaatcttccgcagatgcgagcgcctcttccaatttttcaggctgctttccgccggcctgcgccatgtccggacggcctccgcctccgcctccgcagacttcagccgcttgtttgaccattttgccggcgtgaaggcctttttcaatcaggtctttcgtcacgcctgctgaaaggttgactttctcgttttgcacggcgccgagaatgatgaccgcagaaccgagcttcgctttcagatcatccaccatagtacgaaggtggttcatgtctttcgcatttactttttcagccagcacttttacgccgccgatgtcttttacttttgacagaatggctccggcttccacattgccaagtttgctgagcaatgattcattttctctttgcgcttccttcagctccgcttgaagagactgaattcgcttcggtacgtcttttacgtttgatttcagctcatccgcagcgtgctgcagaaggctgagctggctgttcatttcctgataagcgccttttcctgttacggcttcgattcttcgcgtacctgcgccgatccctgattcggatacgattttaaacagaccgatttcagccgtattcgtgacatggcatccgccgcaaagctcaaggctgtaatctccgacttgtacgacgcggacgatatcgccgtatttctcgccgaacagggccatcgcgcccatttctttcgcttcattgatcggtttcaaatcaatcgctaccggaatgctctcccagattttttcgttgacgattccttcaatgcgttcaagttcttctttcgtcacttgaccgaaatgagagaagtcaaaacgcagacgattttcggtaacgagtgaacccgcttggttgacatgtgtgccgagaacgtctttcagcgcctggtgcagaaggtgggttgctgtatggtttttcaccacaccgcttctcatttgatcttcaacttcagccgtcacgcttgcgcctttttgaatcgtgccgctatccaccgtgccttcgtgtacatgctggccgttcggagcttttttcacgtctttaatggttacgacagcctgctcgcttctcagcactcctctgtcaccgatctgtccgccgctttcagcatagaaaggcgttttgtcaagaagaatttggacggtatccccttcatgcgcctcgctgattaattgcccgtcatgaagaagctcgatcaccttcgcttcagcttttacggcactgtagccgacaaatgtgctttctgcggtaatgtcgcgcaatgcgccgccctgcacctgcatgcttcctacatcttggcgcgcatttctcgcccgttcacgctgtttttccatttcggcttcaaagcctttatggtcaaccttcatttgctcatcttccgcgtattcctccgtcaattcaaccgggaatccgtacgtatcgtacagtttgaatacgtcttttccggagatgatgccgctgcctttttccttctctttctttatcacgtcagataaaatggccagaccttcgtttaatgtttcgtggaagcgctcttcctccgttttgatgactttggcgataaactcttgcttttctttcacctccggatagaaagcgtccataattcctgcaacagtcggtaccagctcgtacataaacggacggctgataccgatggttttcgcgtatcgcactgccctgcgcaagaggcgtctcagtacatacccgcgcccttcatttgacggcagagctccgtcgcttaccgcaaatgcgaccgttctgatatgatcggcgatcactttaaaggccgtatccttcattgcgtcctttccgtaagcatctccggaaatgcgctctgttgcttcaataatcggcataaacaaatcagtgtcaaagtttgtcgggacatcctgaatcacggagaccatccgttcaagccccatgcccgtatcaatgtttttcttcggaagcggtgtgtacgtgccgtccgggttgtggttgaactctgagaataccaggttccatacttcaagatagcggtcattttcgccgcccggatacaattcagaatctgacgggtcattaccgtatttctcgccgcggtcatagaaaatttccgtattcggtccgctcgggccttcgccgatatcccagaagttcccttccagacggatgattctttcttccggaacgccgattttttccgcccatagcgtataagcttcttcatcctcagggtgaaccgttacagacagcagctccggatcaaagccgatccacttttcgctcgttaaaaactcccatgcccacgtgatggcttcttctttaaaataatcaccgatggaaaagtttccgagcatctcaaagaacgtgtggtggcgcgccgttttccccacattttcaatatcatttgtgcggattgatttttgcgcgtttacaattctcggattctccggcacaacgcggccgtcaaagtactttttcagcgtcgcaacgccgctgttgatccacagtaaagacggatcttcatgcggaaccaatgaggcgctcggttcaacggcatgacctttttctttaaagaaatctaaaaacatttgacgtacttcagcagaagttaagtgtttcatctatattcctccttatcactacccgaaattctcttttgcgacagcaaaaaagctctctccctatgcaaaccatgcgttcacacagggacgagagctgtctcgcggtaccaccctgattacaggccgaaaaaggcctgtcacctttcatcccgtaacgcaggattgcggcagcctttaactgcactcaggattagcttcggccgatcttctgctgaagctcctctcagcgtatcggagcttctctcttaaacagggcttcggcgtactcttatccgtcactcgagattcgtatgtattctactcgaaattatagacaagcagaacccgaatgtcaatgttccgtcctgatccgcaaaaagtgaatggccgtcacttttaaaacggctgccgccggaacagcgagaatcatgccgggaatgcccgcgagctctcctccggcaagaagcgcaagcatgatcacgacggggtgcattctgagacttcgcccgacaatgagcgggctcaaaatgtttccttctataaattgaagaataaaaatcgtgacgattacgatgatcacagccttggaggaaatcgccagcgaaaggagcagcgccggcacagcgccgataaacgggccgaaatacgggatgacattcgtaatcccgatggcaaggcccaaaatcagcgggtaaggaagcccgaagagccaaaatgaaacgccggctattaacccgagcaaaaaacaaacgagaagctgaccgcggatgtaatcaccgagagagtcgtccacatcccgcagaaattcactccccctttttctccaggacttcggcgtcaaataccagaccgtctttttcatgacgcctatatccttcaccatatagaacacgagaaaaggaatcgtcgccgcgatcaggatataatcaagcacgaaacggatgcttctgatcgtgctttcaatcgtgccggcaagaaacgtttctgtctgctgaatcattttgtccatccgatggtgcatgccgtcaggccaatgatccgtgtgattatgcagatgcctcagcatgctgttgtagttttcggcaagaccgggaatgctctcagacagatcctgcagctgttcaattaaaacaggaacccctttataaaccccccagccgattccgccgaaaaacaggcaataaatcagaagcaggcttaaagttctaggcatcccttttctatgaagccattcagtaatcggaagtaaaagataagcaataaatactgcgatgaatataggaataaagagagattttataacaagccaaatgggagaccataacatatcgagcatgcaaaagacatacactgttaacaaaacgagcagacatacagctgtccacattaagagctgcagcggtttttgaagcatgacgtttcacctcttgctttatcttttgacagaaagccggaattattcccgtttcataaactacgccttatgacgcagacctcttgacggaaataattatcagaaattacgaaataatctaaataatattcataaaagtctgtataaccatcgtaatgtgttaaaggatttcaaaactgtccagtcaatatgactcatgtttttttaaggaggatggccatgatttcatttcaggatgtaaataagcactacggacatttccacgtgctgaaaaacattaatctgcacattaaaaaaggggaagtcgtcgttatcatcggaccttcaggatcgggaaaaagcacgcttctccgctgcattaatcagctggaaacagttgatggaggcgccttaacggtaaacggcgtctccatccgtgacaagaaaacggatataaatcaggtccgccggaatatcggcatggtgtttcagcattttcatctgtacccgcacaaaaccgttctgcaaaacatcatgctcgcaccgatcaaagtgctcaagcaatcaaaagaagaagcaaaggaaacggccttatactatttgaaaaaagtcggtataccggacaaagcggacgcttatccttcacagctttccggcggccagcagcagcgtgtcgccatcgccagggggcttgcgatgaagcccgaaattatgctgtttgatgaacccacatccgcgcttgatccggaaatgatcggggaagtgctggatgtcatgaaaacactcgcaaaggaaggcatgaccatggcagtcgtcacacatgaaatgggattcgcaaaagaagtggcggaccgcatcgtgtttatcgacggcggatccatcttagaagaagctgcaccggctgaattttacgaaagcccccgtgaagagagggcgcgtttattcttaagccgtattttaaatcactgaaaagaaacggaggagcgcttatgtcacgcgcaacaaaatggttgtcattcggattgatatcactgctggccgtctttatgctggcagcctgcggagggaaagaaacgtccggggattcaaaaggaacgggaaaagacacgttagcctctattaaagacagagacaaaatcatcttcggcgtcaaaaccgatacgaggttattcgggctgaaaaacccaagctccggtgatattgaaggcttcgatattgatatctcaaaacagctcgcaaaagatattctgggggatgagaagaaagcggaatttaaagaagtgacgtcaaaaacgaggattccgatgctgcaaaacggcgatatcgacgccatcaccgccacgatgacgataacggatgagcggaaaaaagaagttgatttctcagatgtttattttgaagccgggcaatccctgctcgtcaaaaaaggaagcagcatcaaaagcaccgaagacctgggaaaaggctcaaaagtattggcggtaaaaggctccacttcctcacagaacatcagagaaaaagcgcctgacgcctcagtgctggaatttgaaaattacgccgaagcgttcactgcgcttaaagcgggacagggagatgcgctcacaaccgataatgcgattttatacggcatggccgatgaaaataaacaatatcagctgacgggcgaaacctttaccgatgaaccttacggaatcgccgtcaaaaaaggccaatccggccttgtcaaagaaatcaacgcctctttgaaaaaaatgaaagccgacggcaggtacgaaaaaatctataaaaaatggataaaagaagaaccggcaaaataggacggaccgcgggatgagcatgcatgctcatccccgttttataaggagtgacatagatgaacttttcaattttaacggaaaacttcgatatgtatatggacggtttcctgcacacattgcttgcgagcttcatcgcgctggcaggcagctttgcgctgggcgttctgatcgcagtcatgagaatcacggctttcaaaccccttcaatggatcggcactgcgtatgtggaatttatccgtaacatcccgcttctcctcatcacattcgttttttatttcggacttccgaacgccgggctgagactggacggctttcaggcgggaacgattgcgcttacgatttacacgtccgcctttatcgcagaagccatcagagccggaattcagactgtccccaaagggcagatggaagcggccagatcgtcaggcttcacctacagtcaggcgatgagatatatcattcttcctcaggccgtaaaaatcgtcattcccccgctcggaaaccaatttctcaaccttgtcaaaaactcatcaatactcggagtggtggcgggactcgatttgatgtatcaggcggatctcgtgtcctcgagcactcttgtcgtgtttgatgtctatattttcgtcgcgcttttttatttgatattaacgatcccgctcagcatcggggttcactatttggaaagacgtctcggaaaaagttattagagaaggagagtgaataacatggattttagcggcgcctatacacctgaccatctgctgtttttatgggacggctttttggtcacactttatgttgcgctgatctccattgtcctgagttttatgttcgggcttgccgccggcactttgcgctatgcgaacattcctatcgtctcgggcattatagcggccattgtggaaaccatccgcaacctgccgctgttattaatcattttctttacgttttttgcccttccggaaatcgggatcaaactggaaattaccgcggccgccatcacggcgctgacgatttttgaatcggccatgctgtcagaaatcatcagaagcggtttgcaatccgttgacaaaggacagattgaagcggcgcgttcttcaggactgacgtacacgcagactctttttctcgtcgtcatgccgcaggcgctcaggcgtatggttcctccgattgtgagccagtttatctccttattaaaggatacgtcacttgcggtcgtcatcgctctgcccgaactgattcataacgcgcagattttaaacggacaaagcgctgacggggggtattttttcccgatctttctgctggcggccctgatgtatttcgcggtcaattacagcctgtctctcgctgccagacggctggaagcgagacaaacgtaaaaaggatacttccggagaagtatccttttttccgcttaaaacattttcatgactcgtcttctcatccgtttcataccttttttattcagcatatcggactgagaagccatacgatacataacggctccagcccctaaagccaacagagaggtcattgttctgcccatcgcgcgtatctcctttcaactttaaaaattgatactgcgttcgtcttcagaaaacaaatcatcaagactgcttaacgtgccgtcttcctctacttgatgtgtcgcaattttgcctttggccaccgtcagctcaatgaagcagccccagcaatagtattggtttacgccgattttgccgatatctttacttttgcagttcggacatacaagcacagactacacctcttatccgttcaggacgatgccttctttccccgcttcaataagcatatcggcggcgcggcgcacttggcgtctgccagccagatctgaaaagaagccgtccgagagttcatatgctacgattatgcccctgtccaaacaaaagtatacatcttccagcaaaccgaacatttcaccatcaggcgatttcaccggctgcattttaatctgttcaaaggtgaaacagctcttcggcaaaggctgcaaatgagcatgaccggcagctacggcttcttgatccatctcttttatatcacttgcccctaaaaaaagatgacggttgtgaaacaggcgtttctgctccagcacgaaaccgagaaaccggccgtccagagagaaacatacatccgatatcatcccgagactgcgcccggtgttttcgtcatatactgttcgtccttcagctgcatggcatgttctcaaagtgtgatcaaccaccttttgttgaacacgtataggttttgccaagaagccaggcagcatactttgaaatgacttccacaggcgaaaacccggcgcatgaacatgtgccgggttttatttacgctttttcttccataaagtcaaaaggcgtgatgccttccattccgatgttcgcatcatatacactgaacggcagctctttttgcagggcggccagttctgcatccatctcttcagtctgctctgtgagcctgtttttaagcgacgtctgtctgacggtggcatcattgtttttgacgccccattcaagcgcttcttcttctccgcaaagaatcagaaattttttcgctcttgtaatggcggtataaagcagatttctcctgagcattcgatagtagcctttgacgacaggcaggacgacaatcgggaattcgctcccctgcgacttatgaatggaacagcagtaagcgtgggtaaactggctgaaatcctttttcgtaaaggtgatttcgttgccgtcaaacgagacgacgaccatgtcttctttttccgtattttctttggcataaaaaatggacacgatttcgccgatatcgccgttaaacacattgttttccggctggttgacaagctgcaatattttatcgcccgtcctgtagacgacatctccgaatttcagctcccgccttttttctttaggcggattcatgatgtcctgaagaagcatattcagctcgttaattcccgcttttcccctgtacatcggggcaagcacttgaatatctctggaggtataccccttttttaacgcattcgagacgacctgatccacgacttctttaatctgtgaagaattacagcggataaatgagcggtcctttgtcggcgcggtcagcccctttggaagcagtccttttttcatatcatgggcaagttccacaatggatgatccttcagcctgacggtaaatatctgtcaggcgcacggtcggcagcacttcagaagccaaaagatctctgagcacctgccccggtcctactgaaggaagctggtcttcatcaccgacaacaatgagctgaatgtgcttaggaagcgccttaaacaaatggctggcgagccagatatcaagcatactcgcttcgtctataatgatcagtttcccttcaatcggctgatcttcgttgtaggtaaagccttcagcgccattccagccgagcagcctgtgaatcgtaacagccggcagacccgtagattcgctcatccgttttgcggctcttccggtcggcgcggcaagcagcaccggaaacgcctcgtcttttttataatcaccggggtcaagggatacgccgtgcagttcactgtataattccacgattcctttaataacggtcgttttccccgttccaggtccccggtcagtaaaagcatcggtgaagacagcgctttttgaatggcatccttttggcttggtgcgtattgaacattcatccgttcttccagttcaccgagtgcaagcagaaattccgattcaggaaattgatcggcatactccgtctgagccgcaatgtcgagcacgcgttttgcgacgttttgttccgcgtaaaacaaggagggaaaatagcagcgctctccttcgatgacgatatccttactctccccgagggcgatgatgccgtcagccgcatccatttccgtgacgcggccgccttcagctgactgattcaggagcgtttgcgtattgataatcagctgctttgtctctatgtacgtatggccctctgaaagacaggtcgattcaatcgtatataagattgccgctttgatccgctccgggtggtttcctgacagacccatttttccgcccagctcgtcagctttcacaaagccgatgccttcaacgtcttttacaagctgataaggattttcctgaattttctccaaggtttccgtttcgtaggcctgatatattttcatggatagctggggcccgaaaccgtattggttcagagagatcataatctgttcaagcccctgatgccgctgcagctctcccgccagtttgtccgctttcttttttgacattttcggcacatcataaagcaccgacgcatcagccagaattttattgagcgcgccgtctccaagctttttgacgatttcttccgccgttttttttccgattccttcaaacagatcacttgataaatagtgaatgattccttcttttgtggtcggaatttcttttttaaagtgttcagcctgaaattgcaggccgaacttaggatgcgtggcagtttttccgtaaaatgtgtaggtctcatcttcttgcagcagagggaagtagcccgttacggatacgaccttgtcttcgatcgcctcagacgtttctgcaaccttgactttcagcactgtatacaggttggtgtcattatgataaatgaccgtatgaatgacgccttttacatacggctgttcttcgatgttcagctgatccacgagccttccctccttttgttatgactgggtgataagctgtttcgcatgaagcgcaagcatatgatcaggctgtatgccgattgcgccttccagcatctcaagcgccttttcacgattttctttgtacgcgtaagcgaccccggcattataaaatgcgtccgcgtggcctggatcctgctcgatcaccgtctcaaactgcgcaagagcttcatccagcatttcttcatttgcaagacacattccgaactggaagcgcgcttccgtgtcattttcgtttaattcaacggcacgctgcagatacggcagtgcaagcttcggccgctctaatttaacgagaacggtccccagcatataaaacaaatctccgttttccattccggagcgaagcgctttttcaaacatatccttcgcttcggaaaacgattctttcatcacatatacgtttcccgcaccgtaataagcggctgccgccgaattgtccaattcaagcgctctgttatagaatgcaagcgcccgttcgagttcgttcacagaagaaagcagatttgcgaagttgatgtacggcaccgggtcttggccgttttcctcaatcgctttcgtaaaagcctctgccgctttttcaaaatcgccctcctgcatggcgtcaatcccgattttattataatccatttttaacttcctttcgctaaaaaaccccaacatgcgagttgaggttttttacatgtgttatacgtaccacagttttgttccgtctttataaacgtcatctatcgttccgccgccgaggcactcttctccgtcataaaaaacgacggcttgtcccggcgtaacggcgcgtacctgcccgtcaaaaatgatttccgcttcatcatcacccgtcattttcaccgttactttgtgatcttcctgacggtagcggaatttcgccgtgcatgtcatttcgccgccgtccatcagaccgggacgcgtccagctgacatttgtcgccgtgatcttatcggaatacagaagcggattatggaatccttgatcaacatacagaatgtttttttcaagatctttaccgacggcgaaccacggctcgccgcttccgccgattccaagaccgtggcgctgtccgattgtataatacatcagaccgtcatgacgcccttttatttctccgtccattgtcatcatatcgcccggctgagcggggagatattggctgagaaacgttttgaagttgcgttcgccgataaagcagattcccgtgctgtcttttttcgcagctgtcgcaagttctgcttctttggcaatttcccgcacgcggcttttttgcagatcaccgatcgggaacatgactttactgagctgttcctgattgagctgattcagaaaataagtctggtccttgttttcatccagaccgcggagcatgcgcactgtatctgcgcttctgtccacgcgggcgtaatggcccgtcgcaagataatccgcgccgagtgacagagcatgatccaagaaagccttaaacttaatttctttattgcacatgacatccggattgggggttcttccggctttatattcatcaaggaaatattgaaataccttttcccaatattgcttctcaaaattgacggcataatacggaattccgatctggttgcagacccggatgacgtcttcataatcttccgtcgccgtgcaaaaaccgttttcgtccgtatcatcccagtttttcataaagattccgattacatcgtagccctgctccttcagcagaagggccgccacggaagagtccacgccgccggacatgccgactacgactcttgtatcctccggccgtttttccatttgcattcactccattaaaaacataagtccgccgttttaagcaagccgtttaacgacggcggcaagcttttcggcggctgtttcgatttgttccgccgtattgccgaggccgaagctgaggcggattgacgaagtcagcctgccgctctcacttccgaacatggccgtaagcacatgggacggaagaacggatcccgccgtacaagcagatccgctggagacggcaatgccttccatgtcaagattgaccagcagcgcttccaccggcacaccgggaaagtaaaggtttaaaatatgaggcaggcatttctcggcatctccgttcacctccgctgtaacgccggcttcttccagcgtgctcatgatgatgttcttaaactccttatacttcgctgttttctcttccctctcacggtttgaaaggacgaccgcttcttttaagccggcgatgcccggtacattttccgtccccgcgcggcgctttcgttcctgctctcccccaagaagaatcggtgacagcttcacctcttgatttacatataaaaagcctgtccctttaggcccgttaagcttgtgaccggaaacagacagcatgtcaattctgctttttttcacatcaatcggcatataaccgaatgcctggacggcatctgtgtgaaaataggcctgatgcccgcttaacagctctccgatttcgtcaatcggctgaatggttccgacttcgttattgccatacatgacggtaacaaggattgtatcatcacggagcgcttctttcacctgatttgcactgatccgtcctgaagggccgggcatgaggtatgtcacctcaaagccgtcttcttccagcttttcgcaggcgtgcaatacagcatgatgctcaacagcggtcgtaatgatatgctttccttcattcttccgggcggcagccgttccgaaaatggctaaattatcagcctccgtaccgccgcttgtgaaaataatttcctgttctttcgcactgatttcgcgcgcgatgtccgctctcgcttcatcgacccatttccgggattctctcccgaatgaatgaatgcttgacgggttgccgaaactgccgaagaaatggggcttcatttcttcgagcacacgttcatccatgggggaagtcgcagcatgatctaaataaatccgttccattgtctttacacctctggtttaaatatagaacatataagcttcctgctcgccgtccgtgtagctcgcaaggtcttctaacgtcgtgctgtccagcacgtcttttacagcgtcgcggatgcggatccataactcccgcttggcaggctcttcatcctcaagcacttctaccgggctgatcggcccttccagcactctgataatatctccggccgttatctcttcaggctggcccccgagcacgtaacccccgtaagcgcctctgatgctttttacgagtccggcgtttctgagcggtgatacaagctgttccaagtaatgctcagaaaggctgtttgtttgggcgatgcttttgagcgacgtcggaccgtctccgtgctttttcgccaattcaatcataatggtgagcccgtatcttccctttgtcgatattttcaatatgaacaccccagtcaattctaattgttaatttatacaagtaaatggatatgaataatctgtttagtatcttatagaccaactgttattataacataacttatcctaattttcattgaaacacggggcccgccgcaattcgcttttctaatcgtccgttttccgttaccctgtatatgtaaggagagatgttcatgaaaccattggcgtatcggatgcggcctgccaatatcgaagacattatcggtcaggaacatttggtcaaagaagataaaatcatcggcagaatggtgcgtgcgaagcacttatcatccatgatcctgtacggaccgccgggcatcggaaaaacgtccatcgccacagcgatcgcaggatcgacaagcatcgcattcaggaaattgaatgccgtcattcataataaaaaagacatggagattgtcgtacaggaagcgaaaatgtcaggccaggtcattttaatccttgatgaagtgcacagacttgataagggaaagcaggattttctgctgccctatttagaaaacggcatgattattttaatcggcgcgacgaccgccaacccttatcatgccattaacccggccatcagaagccggacccagatatttgagcttgaaccgttaacacccgatctgatcaggcaggcattgaaaagagcgctcacagatgaacaccggggactcggttcctacagcgtttcggtggacgacgacgcgatggatcatttcgcacaagggtgcggaggagacgtccgctccgctttgaacgcactggagcttgccgtgctctccacaaaggaatcaagcgacgggacgatccggattacacgggaaacggcggaagaatgtctgcagaaaaaaagctatacccatgataaaaacggcgatgcgcattatgacgtcttatccgcgttccaaaaatcgatccggggctcggacgcaaacgccgcccttcattatctggcccgtctgatcgaagccggagaccttgaaagcatatcaagaaggcttctcgtgatcgcctatgaagatatcggcctcgcaagcccgcaggcaggcccccgggtgctgagcgcgattcagaccgcagaacggatcggctttccggaagcgagaattccgctggccaatgcggtaatcgaattatgcctctcaccgaaatcaaactccgccatttcagccgttgatgaggcgctcaaagacatcaggacgggtaaaatcggcgatgtgccgaaacatttaaaagacgcccactataaaggggcccaagagctcggacgcgggatcggctatcaatatccccacgatttcgagaacggatgggtcgaacagcaatatttgcccgatccgttaaaaaacaagcaatactataaaccgaaacaaacggggaaatttgaagccgccataaagcaagtgtatgaaaaactgatgaagcagaaaaaataaccggacaagatctttcgtgtaaacggcggattcaaataaaaaaacagcctttcctgaagaaggctgtttttctttttacttatctttaacccgtttaatgtcgatgtcctttaagagctccatgacaacatgtccgcccataatcagaccggccactgacggaacccaggcgttggaagacggcggcatttgcgctttgcggattttcgcttcatcattcccgacttcttttctgacgtcttcacggatgacgatcgggctttcatcagaaaaaatgacctgtacgccttttttaatgccctctttacgaagccttgtgcggacgactttggcaatcggatcagtatgggtttttgaaatatcagcaatctgaaagcgtgtcgggtctgttttattcgctgctcccatgcttgaaatcagcggaacattccgtttcagacattctttcatcagatgaattttataatgaatcgtatccgacgcgtcaatgacgtaatcgagcggatactcaaagaactgctcatacgtctcttctgtataaaacatttttaaggcgacgacgtcacaatccggattaatatcagcgatccgctctttcatcaattctgttttcggctgtcccaccgtcgacaatagcgcatgcagctggcggtttacgtttgtaatgtcaacatcatctttatcgacaagcacgatccgccccactccggacctcgccaatgcttcggctgcgaatgaaccgactccgccgacgccgagaacggccaccgtgctgttttttaacgtgtccagcccttcttttccaatcgctagctcatttctggaaaactgatgtaacaagaacctcactccacattctggttttataaactcggcttgtcaaaaagccgctggttttagcgcacaaaaaataaagtcccaattgtgccgttgcagctttccttcgttttgaacccgctctcagcaggtgggtgcccttttttaaatcttgtaagtcctctttagcgaatgaaaagaggcatgtacgccatttaaaaatgcgggctcccaaatcaaaaaaatgttcggtcaaaactaggtgtacaactaacacatcaggactttatttaacttgtcaaaatcatatcacagcagattttgattttcaagaaacaaactgccgatctttactgtttcacttttcttttgacagaaaggtgaagttcttcaagctgggcgtcgctcacttcgccgggcgcttccgtaagaaggcagcttgcgcttgccgttttcgggaaagcgatcgtatctcttaagttagtgcggcctgcaagaagcataaccaaccggtctaagccgagcgcgattccgccatgcggaggagcgccgtattcaaaggcttcaagaaggtatccgaactcctcctccgcttcttcttttgtaaagccgagaagcccgaacattttttcctgaacgtctttttcaaaaatacggattgagcctccgccgagttcatagccgtttaagacgaggtcgtaagcctgcgctttcatatcttcaggcgccgtttcaatcaggtcaagatcttcacggacaggcattgtaaacggatggtgagccgcatagaaacggccttcttcctcgtcatgctccaataacggccagtccacaacccacaggaagttgaagaggctttcgtcaatcaggccgcgttctttgccgagctttaagcgaagcgcgccgagggattgagccacaacctcaaacttatcagcgccgaacaggagcagatcgccttcagaagcatcaagcgcttcagccagttttgcctgcttctcttcatcaaagaatttcgcaatcgggccttttacgccgtcagcttctactttcacccaagcgagacctttcgcgccgtaatttccggcaaaaacgccgagcgcatcgatatcttttctggaatagtcgccggcagcgcctttgacattgatcgcttttacaacgccgccgtttgccacggctgatgagaacaccttaaattcagtatctctcactatgtctgacacgtccgtcagcagcatgccgaagcgggtatcgggtttgtcggaaccgtagctgttcatcgcttcttcatatgtcattcgcggaagcggaagcgatacttcaacgccttttgtttcgagcatgactttcgccatcatctcttccgccagagccatgatgtcctcttgactcataaaggacatttcaatatcaatctgcgtaaattccggctggcggtcggcacgcaagtcttcatcgcggaagcagcgggccacttgataataccgttcaaagcccgacaccatcagaagctgtttaaaaatctgcggcgattgcggaagggcgtaaaattccccttcatgcacccggctcggcactaagtaatcacgggcgccttcgggagaactttttgttaaaatcggtgtttcaatatcaagaaatccgttttcatccaagaaatggcggatggattttgtgacttgatgccgcatttgcaatgtttgaaacatcgccgggcggcgcaaatccaaatagcggtgttttaaccggacgtcttcagaaacgtcagccgcctggtcactgatcggaaacggaggcgttttcgccgtactgagcaccgtcaccgcttcagctttgatttcaattttaccggttttcaggttgggattcaccgtgccttcttcacgggcagaaaccgtgccttcgatatcaagcacatattcgtttctgattgcttccgctgcggcaagggcttccttcgatacgtcagggttgaacacgacttgcacaatacccgagcggtcacgcaaatcaatgaaaatcaagccgccgagatcgcgccgcttctgcacccaccctttcagtttgacggtttcgccaatcgctttttcagttatctcgccacaataatatgttcttccaaacatagcgttcctctccttcactgcttttgatctgcctttaacacttgtatcagctcgtctaacaccacttcacgctgctctcctgtttccgcatcttttacattgattttattttgggcaagctcatcttcccctaaaatcgcaataaaacgtgcgccgagacggtcagccgttttgaattggcccttcatctttttattttcataatcgatttcacttgagatgcccgcttctctcagtttgtacacgagggaaacggaataatccttcgctttttctccgagcgtcacgatgtagcagtcgatcccctgattgacgggaaggtctgttttctcagcgtcaatggctgccagcagtcgttcgatgctcatcgcaaatccgatacccggcgcttcaggtccgccgatctgttcaacaagcccgtcatagcggcccccgccggcaagggttgtaatcgctccgaatccttcggcattgctcataatttcaaaagcggtatggttataataatcaagccctctgacaaggttcggatctatttcgaacgggatgccgagaccgtttaagtattgttttactttctcaaaataagcggctgattcttcatttaagtaatcaagaatggacggagccgttttcatcagttcatgctctctgtctttcttgcagtcaagaattctgagcgggtttgtgtgcagacgcgactggcagtctgagcaaaattctccgatgcgcggttcaaaatgtttgacgagcgcttcccggtaggatttgcggctctcctggtcaccaaggctgttcagcacaagcttgacatgtttcaaaccggctttacggtaaatactcatcgcaagcgcaatgacttctgcatccacggccggatctttggagccgatcgcttcaattccgaattgataaaattggcggaaacgccctgtctgcggacgttcgtaacggaacatcggtccgacataataaagcttcgtcggctgcaccgggttcgcaaataatttattttcattgaacgcgcggactgcggcggctgttccttccggccgaagcgtcaagcttctccctttgcggtcttcaaacgtgtacatttctttctgcacgatatctgtagactcaccgacgcctcttgcgaataattccgtatgttcgaagatcggcgtgcggatttctttatattgataagtgcggcacgtctccctcataatttgttcgacgaactgccatctgtctgattcacccggcagtatgtcctgtgtgcctcttggaatgtgatatgccatgttacaggcctccttaatgtctttcttcaaataaaaaaactcccgctcctactatacatgtatagtagggacgagagttatacccgtggtgccaccctagttggaatgccgaagcatccccgctctgacctttaacgcaggttcacgtccgctgcctaatgacttgcaaaagcgttcagcagggaacctccggagtgttgtttcgagaaagatgcagtgcggatccgctttcagcccgggacggttcctctcttttccatgcattctgacctactcttctccattatcggttcaaaatcgttatcatgagttatgtacatcaatttctattataataatgggattgcactcccctgtcaagttttattccgtctgtttttccttgcgaccgcttctttcgataagagaccgaactccgtcgccgtctcttcaagaaaacccgccttttctctatcgctctgatcactgaagtgcagatttccttccgcatcgtgcagcgcgcgtcccatttttggttgatatttcatgatttgcacaccttttcgctgtatttatgactagtataaacaaaccattttatttttatttaacattcagcaaggaaaatacgatattatacaagaatgtattttagttagttcagaaaggaggacagccatgaagaagagaactcttgctcttattttatgcggcgtcatcatcacagcgcttcttccgtcatttcacaccgcaatcgccgcagagggagaagcggtcatcgcgacagacaagatcaatgtcagaggcggtcccggcctgagctacggaataaaggctgaagtaaaaaaaggggaaagatacccgatcgttaaagaagagggagactgggtacagcttcagctgagccccggtaaaaccggatgggtcgtttcctggctgatatcaaaaacagccgggggagcagacaattcatccgcaaaaagcggaacggtcacttccaccgatcctgacctccgcatcagaaaaggcccggggacatcgtatgaagtcatcggcaaacttccgcaaggcgcgcatgcatccgtgctggacaagaacagcggatgggtgaacatttcttatcaaggcacaaccgggtgggtttcttccgaatacgtcaccgcggacagcggcggatcggatacgaaagcaacttcggcccgaagcgggtcaaaaagcgggacggtcggcgtttcttcattgaatgtcagaagtgcagcgtcacatgattcagcgattatgactaaattatcacgcggaacaaaggtttccatcttaagtgaagaccacggctggctgaaaattgaagcaaacgggcaaaaaggctgggcagcaagccactacatcataaaggattctgactcatcgggcagcgcatccggctcgggagacggttctgcgggctcaggctcctcgaaaaaagcgtatattgtttacggcggcaccaacttaaggagctcggcctcgacttccgcttctatcgtaaaaagggcagataaaggcgcagcctacccgattgtcggctcaagcggcaaatggtatgaagtccggcttgaaaacggacaaaccgcatatgtggcagactgggtcgtacaaacgtcaaaaagcggtgaggaaacaggcgaagcaccttctcccaacacgtcaggcggcagcggctcacttaaaaacaaaacgatcgtcgttgatcccggacacggaggaaaagacagcggaacgatcggctactccggaaagtttgaaaaaaacgtaacgattaaaacagctaagctgttagccggaaaattgagagcggccggtgcaaacgtgtatatcaccagacaggatgatacatttatcagcctgcaggccagggtttcaacctctcattaccggaatgcggatgcctttatcagcattcactatgacagttatgccgatacgtcaacgcggggaagcacggcttattattacagtccgtctaaggaccgccagcttgcctcagacgtccattctgaagtagtgaagcgttcccctattcctgatcgcggcgttctgtttggcgattattacgtcctgagggaaaataaacggcctgccatgctgtatgagctcggctatctcagtcaaccgcaagaagaaacaatcatacatagcggctcttatcaggaaaaagtgacagacggaattgaaagcggattggaacattattttcaatcataaaaaaaaagctgccgaacggcagcttttttattgtttagaatccataatcaatgtaatcggcccggaattcgtcagctgaacatccatcatggctccgaatattccggtttccactttgactcctttttcccgaaggagttcgttccacttttcataaaggagcacagcctgatccggtttagccgcattcataaaattcgggcgtctccctttctttgtttcgccgtaaagcgtaaactgggaaacggataaaatctccccgcccgtatccaaaagcgataaattcatcttgccgctttcatcatcaaatatccgaagattcacgattttatccgccaagtaagcggcatcttcttctgtatcttcatgagtgatgccgacaagcgccataataccgggtccgatccggccggcgacagcgccgtcaaccgtcacactcgcttctgttacacgctgaacaactaatttcatagcaagctccttttagttcattacccgccggactgaatagatgtctctgatctgcttaatccgctcgaccactttgtgcagatggttaatgttttgaataaaaatcgccatatgaatcgtagcgactttattgcggtcggatttgccggagacagaggagatgttggttttcgtttcatttacggcttggagcacctcatttaaaagcccgagacggtcataccccaaaatctcaatctcaacgttatattctttgcgtctttgaacctgtgattcatgctcccattcaacgggaatcagacgttcctgcgcttcattcgttttgacgttcggacagtcgtcccggtgaacggatacaccgcgcccttttgtaataaaaccgacgatatggtcgcccggcaccgggttgcagcatttcgacaagcggacgagaaggttgtcaatgccttttacgcgcacacccgcttcccgttttctcccttgaggataatgtttcggctcggaagtgacttcctgaacgattttttcctgctcttcctggtcacgcagcttccgttctttttcggtgagcctgttggccacctgaagagcggtaatgccgttatatccgaccgccgcgtacatatcctcttcatttgagaaattgaacttgtcggcaactttttgaagattttcgagcgttaaaacatctttcacttcaaaatcaagatttttaatttctttctcgacaagctcacggcctttttcgacattttcttcacggcgctgtttcttaaagaattggcgtattttgtgtttcgcctgggacgtctgcgccagtttgacccagtcttggctcggaccgtaagaatgcttggacgtcagaatctcgacgatgtcgcccgtccggagcttatggtcaagcgtcaccatttttccgttcactttcgccccgattgttttgttgccgatctctgagtggatcctgtaggaaaaatcaatcggcacagagcctgacggcagttcaatgacatcgccttttggcgtaaatacgtataccatgtcagaaaacagatcgattttcagcgattccataaattcttccgcatccgtagactcgttttggaattccagaatttcacggaaccaggacagttttttctcaaatgtcgcttcttcgtttgcagccttgccttctttataagcccagtgtgcggccaccccgtattcagcgatctcatgcatctcaaacgttctgatctgcacttccagcggatcgcctttaggcccgattacggtcgtatgcagagactgatacatattcggcttaggcatcgcaatataatctttgaatctgccaggcatcggcttccagcacgtatgaataatgccgagtacggcgtagcagtctttaatgcttccgacaagaatacggacggcgagcagatcatatatttcattgaactgtttattttgcagcgccatcttgcggtaaatgctgtagatgtgcttcggacgtcctgaaaagtccgctttaatattcacttcttcaacgcgttttttcacttcattgacaacctcttcgacataaagttcgcgttccgcgcgctttttcttcatgaggttgacgattctgtaatattgctgaggattcaaataacggagagcggtgtcttccagctcccatttgatcttagaaatcccgagccgatgggccagcggagcgaaaatctccaacgtctcatttgaaattctccgctgcttttcctgcggaagatgctttaacgtccgcatattgtgaaggcgatccgccagcttgatcaatatgactctgatatcctgagccatagcgacaaacatttttcgatggttttccgcctgctgctcctcttgagatttatacttaattttaccgagcttcgtcacgccgtcgacaagcatcgccacttcttcagaaaatacttccttcaggtcgtcgagggtgacatccgtgtcctccaccacatcatgcagaaatccgcccgcaattgtggaagggtccatttccaaatcgacgaggatccccgccacctgaatcggatgaatgatgtacggctcacctgatttgcggtactgttcgcgatgcgcgttttgcgcatacaggtaagctttctcaacaaacgcaatctgctcctccggcagataagtgcgcgctttatctattacttgctcggcagtcaatacttgttcgttcgccatggaatcaccttttttaaatgtaaactgtattagtttattatcaagaaaaaaacgagagatgtaaagggcagaagttcaaaacacctaaagaatctgtcaggatgatgaaataataggaaaaaagcaccctgacacgagtgcttttttccatatgcggttaatatttcattaatgttaaaatatcataatcgtcaagcttgtctctgccgtcaaggtaagaaagctcgattaagaacgcaataccggctacgacgccgcccagttcttcgactagcttaatcgttgcttcgatcgtgccgcctgttgcaagcaagtcatcagtaatcagcacacgctgtcccggcaggatcgcatctttatgaatcgtcagtacgtcttttccgtactccaaaccgtaatcgactttaatgacctcacgcggaagttttccttctttccgaaccggcgcaaagccgactccgagtgcgtatgcaaccggacagccgataataaagccgcgcgcttcaggcccgacaactaaatcaatttctttttcttttgcatattcaacaatttggtcagtggcgtaacggtatacgtcgcctttgtccatcaatgtcgtaatatctttaaattgtacgccttctttcgggtaatcgggcacaattgttacgtattttttaagatccatctgttctatgtcctcctcgtactttcataagcctctgaaccttggttcatcagcttattcagccattccttcagctcatgggctgcggaataattgagcttctggtctaattccatcagctgctgttttacctgataggtttgcgaatctgccaggtcgcgttttttcgcaccgctcacgacagacagcacaccatcttctattttaacaaaaccgagatcaaaaaacacctttgtcatgaaattgattgtgtcaattgaccatcctctgtgtctcgcaagctctgaaccatgcttgccgaagtcaaaagcgccccttttcaagagaaatgcgtaaaaccacttgaaatcattccgcgatggaaatgaggacaggaaatgttcttcatgattgataaaaacaaaataaatccgttccggcttctttccgtcaagcaaatgctgcaggcgatccgctgacggcggcacatccagaaaaacggcatattttccgtcaagctggagagcttccgcctcggattccgaagtgatctcggcaagctcgcccgtcagctctttttcacggagcttctgagcggttttttcgttaaagctgatgagcacccgtttttccttcggcagtgcggtgaccgtatcttcccacgtccgcttgcctcgaatatcaaaaagctgccattccggcaccgcagcatctttaatcatcagctggggcttctttctgttgttccattcattaatggacatctcgccgacaatggaaatcgttgatccgggaacaactccggcttccagctctcctttgttaaagccgacgcagtcaaggacggcggaatcacttttcaccgtcattttcacgtggtttttattcgctccgatcaggcgcacatcatcaagcacggcatttttcaccatcacatgcggtttagggttaagcatgccgaacggcgacagcatattcaattctgtaatgctttcaacggttatgtcttcaacgccgcagacaagatcaacctcctgaacgggaataaaatcctcttccgtaagggtttcttcagccatttgattcagcctgtcccttaattccgccacatcttcagccttcagcgtcattccggccgccatcggatgcccgccgaaatgaggaagaatgtctctgcactgtgaaaggctcgtaaaaaggttgaagcctctgatgcttcgcgccgaccctttggcgattccctgctcctcatctatcccaagcacaacagcgggccggtaaaaacgttcagccagcttcgatgcgacaataccgacgacacccggattccagccggcttttgccactacaatggcagacgggtttccgccttgctgctgtaccatttcaacagcctcttcggtcatggttttcaccattttctgccgctctttattcagccggtcaatatccgaagccagttcctccgcttcaaactgatcttcggtcatcagcaggtgcacagcgggatcggcctgttctattcttccgacggcattaagcctcggtgcgacctgaaatccgatcgtttcctcatcagcttgtccgatatctccgccggaaagcttaatcagagctttgaggcccggccgatttgtcgtacgaagcctttcaattccgagtgacgcaattaatctgttttcatcatgaagaggcaccagatctgcaaccgtaccgattgccgccaagtccagcatagcttccggcaaagaacccgtaagcgcgtgggcaagcttaaacgccacaccgacgccggccaattctttaaacggatagccgcatcccggctgcttcgggtggatgatcgcaaatacgtcaggaagctcgggtcccggctcatggtggtcggtaataatgacgtctaagcccagctcttttgcgacttcagcttcatggacggcggcgattcccgtatccactgtaatgatcagcgaaaatccccgctcttttatggaacggaaagcttgttcattcgggccgtagccttctgtaaaacggtcgggaatataaaagtcaacgtccgccgacagctgtctgagtgccgtcagcatcactgacgtgcttgtaacgccgtctgcatcgtaatctccgtaaatcataatcggttccccttgagaaaccgccagttttatccgatcaactgcttcccgcattccctttaattcatacgggtcataaaagtctgcatcctttgtatgtaaaaacagccttgcgctttcggcagtatcaaaacctctttttacaagcagtgatgccacaagaggtgttatgtccaattgttctgtgagtgatttgactttttcctgatccggctgctggatttcccagcgcatttttgacgctaacataaattcacccctcaaccaccctattatactagagcggactgaggggtttcaaatgttattctgatccttttttctcttcaagcatttcttccggcggcgcggctgtttttttgccgtccgaatcagccgtcaattcacctgcggatctgttttctttccgcagcattttaatttcgcgcttcagtttcatcacttgaaatataccggctgaaaacacgatcagcgctcccattaacacagagcctaaaatgactaaaatcagcggccattcagcggttccgaacagataatcaacctcaaccgcccgcacgttaatgacagcaaagatggcgacaatcagagtaaatagtaaagcgaatataatagtccattgtttattcatgcgtctgcccccaattattgattcttatcttttcccccattttcccgggagtaaaccccggtctcaggaaatccgggccgttaattgctcgcggaccagctttttcagtccgcttctttctcccgatataacgagggtgtccccttcttcaattacggtatcaatgccggggctcagctgtttttgccggtttttcttcacgatcgcaataatctggacgttgtaatgtttcttgatctccaaatctccgattgtgcggctgacagccggtgcatgagattcggctttaaaccactcaatgacgaggtcatcaagcgcgacttccacagattccagcgctttcggcttatacgtcatcccgcctaaaatagcggaaatctgcctcgcctcttcgtcgttaaattcaacggatgccaagcattcgtcataatcattctcatcgaagtaatagagctcttttctgccgtcatcatgaagaataatactgattttatcgtgatttttcgtaatgacttctactttctggccgatgcccggaagctccgactcacgaacgttcataagaaccccctacatgttttaacaatgatgattgattatgtaagcgtatgtcattatagcaaatgcaggttttaagttcaatgcggcctaaaaaaaacaggctgccttccggaagacagcctgtttccttttactcttcgattgattttttccctttaaattcttttcctttccatacaagccacagctgcgcggcgatgtaaagagaggaataaacgcccgtcaataaaccgaccaataaagcgacggagaagtttgtaattgacgatgagcccaaaatgagcagcacgacgaccacaatcacaacggtcaagaccgtattgatcgaacgtgtaaaggtttgctgcaaactcagattcacgatatgttccagatcggcaaatgacttcggcttgcgttttttcatctgctcgcgtatccggtcaaatgtaacgatcgtatcatttatcgagtaaccgattatggtgagaatagcggcgataaaggttacgtcaacctccagccttgtaatgctgaaaaacgcgacgataaagaaagcgtcatacagcagggatacaatcgcggcgattgccattctgtactcgaaacggattgacacgtaaataatgatgccgattgatgcaattgccacggcatataaagcattacgggccagttcttttccgactgtcggcgataccgtgctgacgttcggttcagatccgtatttgtccttaaagtacgttttgatttcagcgattttttctttggatggctctccgacaaaccgggccgcggcaacatggttctctttacccgagagtacgatgttttccggatccatgccgagagagtcaaagtctttttcaacctgctgcgccgtcaatgcatgattgctctgcacgtcaatccgcgcaccgcttgcaaaatcgattcccaggttgagtttaaagaccagtaagatgataattcccgcaatggttacagcgcttgagaaaataaagaaatattttcgtttgctcgtgaaatcccatttctggaatgccgtatgcggttcagtattttcatctgttttttgaatgtccataatatgttttttcttgacgccgaaccagctttttttccggtcaagccatctgctttccacaagaagggcgagcaggaatcttgaaaggaagacagctgtaataaagcttgtcagtattgacaaaatcagcatcgtcgcaaacccttttacagagcttgtcccgaaaataaagagcacgaccgctgcgatgatcgttgtgatgttcgcatcaaagatcgtcgcaaatgaccgtctgttccctgaacggaaagctgagcggacggatttgccgagtttcagttcttcttttatccgttcataggtgatgatgttggcgtcaaccgccatcccgacacccaaaatgagcgccgcaatacccggaagcgtcagcaccgcctgcatccagtcaaacacttgaagcgtaatatacacgtatacagaaagcgtaatgaccgctatgagtccaggcagtctgtaataaagcagcataaataagaaaacaattgcaataccgatgatgccggcctctaccgtatcatgcaaagcctgctgtccgaattgcgcccctactgaagtagagtatttttcggtcagtttcacaggcagcgcacccgcgtttaaaatattggccaagtccttcgctttttgaacggtgaactgaccttcaatcgtgacatccttcgtgtttaattcctggctcacattcggagcggatacatatttcggatgttttttgccgacttcttttttaaatgaatcgcccttttggtaatcaagccagatcacaagctgattattaggggccattttcttgacttttttcgtcacttctccgaacttatccgcatccttcagcttaacgctgacaatcggttcgttcgtcgtcggatcaaaggtttgcttcgcgccgttttccacgagatcagagccgtttaacagctctttatcattcgtatccctgaacgagagctgcgcttccgttgacagaatttcgcgcgccctgttctgattcgtgacgcccgccagctgaacgcgtatgcggttatttccttcaatctgaatgttcggctcgcttacgccgagaacgttagcccggcggttcagcgcctgcaccgtgctgacgagcacgtcttttgtgattttatcgccttttttgacgggctgcacatcgtacagaacttcaaacccgccgcgtaaatccaatcctaacgtaatattattggcagccggttttgtaaaataccccagccctgtgccgatcaataatacgatcaggaaaaacgcaatcaagcgtccttttttcattatgtatttcctccttaaacctatgccgtcaaatcattatctcagcagttcatccaaagcttcctgaccctcatcgctttccagccaattagacgacttaaaagcttcaacggttgcatagttcataaaatcgccaattttaactgataaaatattaccggccaattcatgcagcggcaattcctttttctgtttccactttttatgtattaagtatgaccataaactctcgtgctcaacatcatcgtatccaaggattttgaactcttcaagtttactgtacaagaaaggccgcaaatgatctttgtacatttcggcgggatgtttctccactgggcgctcgctcctttttccatttttctcgaagacttgtcatgctcggacgacatcggcgcatatctttattgtatatgattccaggtagtttgagaaggcaggggtttataaaatggcaaaacagacttttttaaggggcactcttattctcattgcagccgggatgattacgagaatgctcggctttgtcaaccgggtggttatcgcccggtttatcggtgaagaaggggtcggtttatacatgatggctgccccgacatttttcttggccaccactttgactcaattcggcctccccgttgccatcagcaaacttgtcgctgaagcaagcgcgcggggggaccggcagaaaatgaaacacattttagtgatggcgcttaccgtcaccgggatattaagtctcatcttcacgccgctgtttttatgctttgcgccgattatgtcagaaacgatgctgacggatcagcgcacggttttcccgcttctggcgattacgcccgtcgtgccgattatcgcgatatccagcgtgctgcgcggttactttcagggcaggcagaatatgaacccgctggcgttttcccaagtgcttgagcagatcgtgcggatttcacttgtcgcagtctgcacgacggtgtttctgccgtacgggattgaatatgccgcagcaggagccatgatttcgtctgtcatcggggagcttgcctctcttatttatttattcatttgttttaaagcaaataaaacaatcagaatcagaaaacaatttttcaagtcgattgcaaatggaaaagaaaccttccgccagctgatgagcgtgtcgctcccgacaaccggaagccgcttcatcggaaatttatcttggttttttgaacctattgtcgtcgcgcagagccttgcgattgcaggagtggccaccgctgccgccaccagccagtacggggagctgaccggatttgccatgacggttttgacgctgcccagctttataacctattctctgtcaacggcgcttgttcctgcgatcagtgaaggaatggagcaaaaaaagctgcaagttgtagaataccgtctggaacaggcgatgaggctgtgtcttttaagcggaggcatttcggtggttattttattctctttcgctgatgaactgatgtccgtcatgtacggatcaactaatgcggcggtatttgttaaagtgatggcgccgttttttctgctttactattttcaggggcctcttcaggcggtgctgcaggctctcaatttagccggggccgccatgatgaacagttttatcggcgccgctgtcaaaaccggcctaatttttgttttggcgaccaggccttccttaggcatcatgggcgccgcacttgcgattgtaacggggatggtccttgtcaccctgctgcatgcggccaccgtaagcaaggtgcttccgatcagcattaaaataaaagaatacgcgctctgttttgccgtcatattcatttgcggttatgtcagccgcatcatcaagcacaccgttcatttttcaggatcagaggctgttaatctcacaggctggattgcaatgaccgcgattttgtacattgcgctgctgctgttattcaggctgattaaaagggaagagctgatccggattccggtcatcggcaagttcgtgacgcggtgaagccgatttatggctcccctttttcatctttgagatcaataaaaaaagcgccgtccgtaaacgtgcagaatgatataaccgaaagatcgcgatatcctctttttgctaaatttttttcaagccagtgtttatctttcccgattctgtccagatgctcgttctgaatgaccccgtcaacgataagcgatgtttccatctgcttatccttattgtttttctttttgacgattgacagtttgcccgaagactccaaaatggcatacgatacgtcagagattctatcgatgttattctccctcagctgcataagaagatcgtcaaaattgtagcgctgcgatctcatcgcccgttcatcaatttttccctgttttataataatggtgggttttccgtcaagcagctgccgtattttttggcttttgagcgaaataaaagcaaggcttacttgaataatcattaaaacgacaatcggcacaattgtatgcaaaagcttatcttttacattttcaattgccaatacggcaatctcggcaatcataatggagacgacaaggtctaaaatgctcagttctccgatttcccgttttcccatcagtctgaaaatcacaagaatgataaaataaagcacaatcgtacgaaacgtaataatgaaaatatcttccatatcgcacctccaacggtcatagcatttgccatcggctctgaattatgtaagaaacgggctgaacatcatgcatttacgtctaattcgaacattcagagaatacatttagaaaaagacgggctccggcttgtcatatatcaggccgcagagcggagaggagataaaaatggaagaaacgaaacaagtgggaagaggcgttttgtacggcttagtggctatttttgcggtgatgcttcttacgagtttggcgatttcgcttttactgacagtcacctcaatggaagaatcatctttcagctggctgatcaccgcgctttcttttctttctttatttgcgggaggttttatatcgggcggcaaagcgaaggaaaaaggctggatgatcggagcgttaaccgccgtctgtttttcattaatcatcttgctttttcaatatttagggttcggaaaaacgtttacatccggtcagcttttgtttcatctcggctttttgggagtcagtatgctgggcggcattttcggagtgaatttgaaaggaagcagatcagcgtaataaaaaaagagcggattctccgctctttttttgtatgtatgagcttcgctgttattcagcggaagcttctctgattgcgcggcggtcaaatgttaaacgggtgttatcacctgttttaatgacgaccttgctttcatcaattgaatcaacagtgccgtgcaatcctccgattgtcaccactgaatccccttttttcagctcttcctgcatctggcggacggccttctgctgcttttgctgcggacggatgagcaggaaataaagcactgcaaacattaaaataataggaacgattgtgcctaaagtacccatctgtttccctcctttcatgaatggttttatttagaagcttttcgcatttggcttattatagccgtaacgctcaaagaactcttctcggaaatcaccaagacgatcctcccggatggcttgtctgacctgctccattaagtgtaacagaaaatgaaggttatggtaagttgttaatcgaattccaaacgtttcattacagcggatcaaatgtctgatgtaagcgcgggagtaattttggcatgtatggcagctgcactcttcgtcaatcggacggaaatcacgctcatatttggcgtttttcatattcagacgcccttcattcgtaaacaccgtgccgtttcgggcaatccgggtcggcagtacgcagtcaaacatatccacgccgcggatggcgccgtcaattaaggcatccggtgaacccacacccattaaatatctcggcttgtccttcggtaaaagcggggttgtaaactcaagcactcggttcatgacgtgcttcggctcgccgacagataatccgcctatggcataccccggaaaatcaagcgaaaccaagtcttttgcactttgtgtccgcaggtcttcgtattctccgccctgtacgattccgaacagcccctgctcatctgagcgcccgtgcgcctccaggcagcgttccgcccagcggctggtccgttccacagagcgtttcatgtaatcatactctgccggatacggcggacactcatcaaacgccatcatgatatcagagccgagggcgttttgaatttccatcgctttttccggagataaaaacagcttgtctccgtttaagtgattgcggaaatgaacgccttcttcttctatattacgaaacttgctcaatgaaaagacctgaaaaccgccggaatctgttaaaatcgcgcggtcccagttcataaacttatgaagcccgcccgcttcttttacaatgtcgtgtcccgggcggagccataaatggtacgtattgcttaaaataatgcccgcatccatagatttcagctcatccggagacatcgtctttaccgtagcaagcgtgccgaccggcataaatacaggcgtctcaaaggagccgtggggcgtatgaactctgcccagccgcgctcccgtttgtttgcattcctttataaattcataacgtatcggttgttcagccactttgtatgaggcctcctgtcttcaaattagataatcagcatggcgtcgccaaagctgaagaaacggtattcctcttctaccgcatgacggtaggcggaaagaacatgctctctgccggcaagcgcagaaacgagcatgataagggaagatttcggcagatgaaaattggtgatcatgccgtcaatcgctataaattcatatcccggataaatgaatatggacgtccagccgcttgaagcggtaaatacgccgtcatgctcgccggcaatggtttccagggtgcgcgttgatgtcgtcccgaccgacacgatgcgccctcccgcctttctgacctcgtttaaagaggcggcggtttcttccgtcatttcataaaattccgcgtgcatgttatgctcttccacatcatccgcactgaccgggcggaatgtgccgagtcccacatgaagtgtgataaattcaatccgcacacccttttgcttcagctcgtccagaatctcttccgtaaaatgaagtccggccgtcggagctgcggcagatccgatttcttttgaaaagacggtctgataccgttctttatcatcaagctgctctttaatataaggaggcagcggcatttcaccgagtgattcaagcacttcgtaaaaaatcccgtcataccggaattctatttttctgcctccgtgatcaagctcctccgtgcagaccgctgtcagccggccgtcgccaaatgtcaggaccgttcctttttttacgcgtttcgccggctttacgagcgtttcccatgtatcattttcttcctgttttaataacagaagctccactttcgctcccgtatcttcttttgtgccgaataatcttgcaggcagcacacgggtattgttcaagacgagacaatccccttcattaaaaaagcttacaatctctttaaatgaactgtccgtcagcccgcccgtctgtttgtcgagcaccatcagccgcgatgcgtcacgttctttcagcggcacttgggcaatgaggcgttcaggcagttcaaaatcaaataaatcgactttcatcatttcacctttattctgtctattgttatttcattctgccgaaaaaattaagcagaatggatagtatcacactgatcacaatacaagtgacaacgggaaagaaaaatgtaacatttcccttcttaacgaaaatatctccgggcagccttccgacaaagtgccagactgcgccggcaataagcaaaacggcaccgagaaccatgagaaccttcggaaagtcagtcacgggcgggcgcctccaatcgaaaatgttcatacacagccggagtcacgacccgtcccctcggcgtcctctggagaaatccgatctgcagcagatacggttcgtacacatcctctattgtatgcggttcttcgccgattgtcgcggaaatcgtatcaaggccgacgggacctccgctgaatttttcgatcatgcccatcagcagcttatggtcgatatggtcaaggccgagcgcatcgacttgaagacgttcgagcgcgtcgtgagcgatttcttccgtgatgcggctgtcgccgagcacctgggcaaaatctctcacccttctgagaagccggtttgcaacccgcggcgttccccttgaccgtctggcgatctccagagccggagcttcttcgatatccacttcaaaaacgtcagccgttcttgacacgatatctgtcagctcttcctgcgtatagtattcaagacgcgacagcaccccgaaccggtctctgagcggtgcggtcaataatccgacccttgtcgtcgctcctacaagcgtaaaagggggaaggtcgagacggacggagcgggcggacgggccttttccaatgacgatatcaaggcagaaatcctccatcgccgggtacagcacttcctcaatcgagcggttcagcctgtgaatttcgtctataaacagcacatcccctggttcgagcgccgtcaagatggctgccaaatctcccggtctttcgatggcgggacctgacgtcgtccgcatctccacccccatctcattggccacgatagacgcaagcgttgttttcccgagacccggaggcccgtataaaagaacgtggtccagcgtttcctgcctcattttcgccgcatcgataaacacgcgcagattttctttcaccttcttttggccgatatactgggcgagattctgcggcctgaggctttgctcgattattgattcatggctgtctgcttcacttgaaacgagccgttcatccatgaacatcaccttactttaataatttttgcaatgcttttttcacatattgatctgttgaaagcgccgtttcctcttttaagtgaggaagcacttttttaatttctttttcggcgtagccgagaaccctaagcgcttcaagcgcctcgtcaagcgccgtttcagcctcttgtttttcaatgcgcgcttcatgattgaacaggttgtcaatcatttcaggcacgacgtcggccagtttgcctttcaaatcaagaataatctgccgcgccgtttttttgcccacacccggaaatttcaccaaaaaggcttcatcttcctgttcgatcgcttcgatgacggctccggggtcaccggaaccgaggatggcgagcgcccctttcggcccgatgccggtgacgttcagcagctttgtgaaaagcgctttttcttcccgggttgaaaaaccgtacaaagaaaaggcgtcttcttttatatgatgatacgtaaaaatggtctcttgattgcttaccttataaataaacgggttcggagtgaagacctgatagccgattccgccgttttcaatcacgatgtattggggagatacataatcaatcgtccccttcacgaattcaatcacacctattcacctctttgactgcttatcattgtaacacaaaaacagccaaagtcttatagaaaagttaacgtatgttcgctttgacatcttccattcagaaaaaaaagacatgtgtcacatgtcttgcgtcaaagtcatccgctgtaagtcttaatatgatcgatcacgctctcaaactccgcttttgtcctgtacggtatgccgtgttccaagtgcttttgcaatcggctttccagcctttctatatcaatctggaagaaagattggatcggctcggccagcgatccgggacggccgtgaaaagtggagatgacgcctccgtccgtgacgccgatataaccgttaaccttactgagcggagaaatgtcatcaacatgcttacggaaaagaacgaagccttttttctgctcaacgagcgtccagcccgcatatgcggcccaaaaatcctccatcgccaaaacggtttcatccgtatgttcgatgccgacatcaccgtccagatagaccttttccagctggacgtgcacccgaagcggcccgtaatgctcaacctccgccccgtatgcgccttttcctccgcaaatcaggactgcagccgataagataagcataaacaatagacgagcaccgcaaattcgtttcaccaataacacctctttattcaatcaaactcttgatgctagtttgaccaaagatgccggtgcttaaccgttttctttcatttgtctgtttcagccgaataaaagcagcctctattatgaaggctgccccgatgattatgcccggccggctgaaatcagtttcatttgtccggacgtcagtttgagccggtatccccttacggtcagatacacagttttttctccgcggcttttgtcatgctccgtttttttcattccggcccctccgttacgttttattacttttatgttaacaccgcaacataaagagcgttttaagaatatgtaaagaaatgatgaagctttatccataaaaatactgccggatgaaatcatccggcagtcccgtttaacggctgtttctgttcatgtcttgcagctttgtaaaagtagcgttgtcggtaaacacttgaattgtacggccgtccgcaaatcttttggccgcatgtttgacatgtttatcatcatttttcgtaaaaggatgatttgttctgacagcaatgacgactctcgtgtcagtcacgatgacctgactatcctgtacgccttttacttttttcacgcggtttgcaacttttgccgccagcctgatgttttcggcgttgtcatacccattataagacatagctgccggcggcgtattgacatttcggccgttatatgtgccgtccgtcgttaacggaaccccgtcattaggcgcatactggtcagacacgtttgtcgtattatgacggccgtttcggttttccatcatttcagaaacgggtccttgatggtccattccgtactggcgtctgccgttatcattatcattcgaataatatccgaccggacgtgttgactgattgtagcgtccgtcattcatggcattatttgctccgcatgccgttaagcttgccgtcacggctaaaacgcctgcgatcgtcatcagttttttacccaatggaaaaaccccccgtggattcatcgctgtttgagcgttttccgctcatgtttaggatgtgcggccgacggcgggtttaagcttgtcagttatgtccattcctcagttggacataaaaaaaggaacgacatacatcgtcccgaaacattaatcttcttcttcctccggccgtccgaatacttgatttggactcggctgattcggtgcggcattaggatttgctccgccgtaaggcataaaatatccggcgtttgcacccacattcggatacggctgcacaggcatatttgcgtgatggtgatgtgaaccgtggtgatgatggtggtggtgatgtgaatcatggcagccgcaatcatcatccttaaatttcccatcatgatgaggcgcgtttgcgtaatgagacgaatatccgccgtaatacggcatttgaccgtacggagcaccgccgaaaccggatgcagaaccatcataatgctctgcattttcatgggcctggttttcatattcaccgtaacccgcttgcggcccaaatcccggatgatggaatccgtgatgatggaatccgtacggtaacggcatcggcattaccggaaagcctccataacctcctccaaaaccgccgaaacctccgcctaccgggaagcacggatggcatagtcccgaacccggcagcatcggtgtcaccggaaccggacaaggacaaggcatgcacggcatcgggtaatgcataaaaggcggttcaacggccggcatattcggaaacgggacattcggaatgtttggcatgttcggcagatgataagcggcgttttcttcttccatctttccggcttcaggcgccttcggcatattcgggtaattcgcgttttccatgttgatcatttcctcctgttgtggaatgttattgtcatgctctttttctttcggctcgacaaaatgtgtcaccggttcctccggcttaggaggcgaccacggctgaaacagctgattggacggataatattggttcatatcagcttccggcagcacattttcatgcttttcagggattggcggcacatacggaattgacggcttcggttcttccggtatggtgtcttcaatgtccacaactgatttcggtttttctttggcatatggatgctcatgcttatgcgcagacgttccgaagccggccttgggttcttttctgaccggaacggcttctgaaggcacctttatcttcattccaggcataattaagtctggattgctaagctgatgattcagtttttttaactcttcaagatcaactccgtatttttcagctattttccagagcgaatcgcctttttgaacgatatgaattttcaacgttttcccctcctatgcacaaaacgtgaacggtacatttgtcattacaatacgtttcttcacactatatgccggtggactgggcatgatgataaaaaatttgggaaggaggggaaatttttatgattacgtatgactcagcattctgttcaaagcacgaagcgcttctgtccgaaccgcttccggaactttaatgacacccttcggctcgcctttttcaagctgctcaagcgaccacaataaatgcggcaggtcgattctgttcattgtcagacacggacacatatcgggattcaatgattcaatctgtttatccgggtgcgagtgaatgaggcgctgaacaagattcatttccgtgccgatcgcccacttgcttcccggttctgcctgttcaatcgtatcaataatatatttggtagacccgctgtcgtcactgagcgagaccacttcccgcgaacattccggatgaacgataatgcggatgccggaatcccgctgccgcagctgaaaaatattttccgctgtaaacttttcgtgtacggagcaatgtcctttccaaaggatgactttaatgttttccggatggtcagtaagcaatcggttctgccccgggtcccatacagccatttctgtcagcggaatgccgaggtcataggctgtatttctgcctaaatgctgatccggcaaaaataaaattctttctttttgtttaaaagcccatttcagcacactccgggcattcgaagaggtgacggtcgctccaccgtgccgaccgacgaatgctttaatttccgccgtcgagttaacatatgttaacggaatgatggtgttaccgtacagttcttgaagctcttgccatgctttgtccgtctgctgaatatctgccatatcagccatcgagcatccggcgcgcatgtcgggcaatatgacggtttggttatcatcagtcagcatatcagcggtttccgccataaaatgcacgccgcaaaacacaatatattccgcctctttatttttttctgccacttgagcaagctgcagggagtcacctgccgtatcggcgaattgtatcacttcgtctttttgatagtgatgccccggaatgaacaggcgctttccgaaatcccgtttaatggcggcgacacgcttttccatttctccggtgctcatgtctttataatggctcggcatcatttcggctgatgcagttaacacgtcaaaaatagacatcttaaaaatccccctgttccgcagcctcaacatccatgctgatgtcggcgctttttactgaatgagtcagaaatccgagtgaaatatattggacgcccgtccctttataagcgggcaatgtgtcgagcgttatgcctccggatgcttccgttttgatatggcccggtgtcatgcctgcaaaacgccggacggactcaggcggacagttgtcaaacataataatgtctgcgcccgcttctattgcctcgagcagctgctgttcggattcgatctcgacttccaccgcaagcatctgccctgccgtttctcttgcccgctccacggccgcctttatcgatccgcaggcggcaatatgattatctttaatcatgatgccgtcatataagccgaagcgatgattaaagccgcctccgacccgaacggcgtatttttccagcattctgagccccggtgtcgtttttctcgtatcacaaagcttaatggacggatcatcaagacgccttttagcctcgtccgtcattgtcgcaatgcctgacattctttgtatgagattcagaatgacccgctccccagtaagaagagctgccgcccggccttccatttcagcgagcacatctccttttttcatccgttctccgtcttttttcagagggcggatgcggatatcatcgtgtaaaagcttccatccttcacggataacgtcttctccggcaaacacgccgtctgtttttgcgatgatccgcgctttacattgctgatcagaaaaaatcgcttgtgacgtcgcatcacccgttccgatatcttcctgaaaaaaatgagtcagcatttgtttcagctgcagaatgtccatagttccccaatcctttcgttttttctgataaccgttccagatgttgaatgaatgatttgttttccgtgccaatctttctccgtcccgggaaaatcagtacgaaaatgagcgcctctgctttcttcccgaataagggctgaggtgacaacaagttgcgcagtcttccataggcaggatagctctgcttgttccattgtgatatccttcacatttatatgatgcacagatacgttgttaagccaggatgtcagcgcctgcaggttttctttttccctgacgatacccgctccggttgtcattttggcttgaagcacatgaatcgttgtgtccggcacttgtaagatgacatcagttttcttcggggtttttttatatcttccgtttaacggtgtttgaatgatatgttcagcacatcgttgcccgcttgccagcgcttccagcagtgagttgctcgcaaggcggttcgccccgtgcaagcctgtgcaggcggtctcgcctatggcgtacaaatcaggcacggacgttttcccccatgtatcggcttttactccgcccattaaaaaatgcattccgggtgctatggggatcccgctttcaagatcaacgccggctgtttgacaaatttctgttatggtcggaaaacgtttgttaaaatcggctattcggctgcaatttataaaaacaggattttctttcatcatttcttcataaatcgcccgtgaaaccacatcccggggcgccaaatcctcaagcgcgtgtctgccagccatgatcctgcgcccgaagcgatctgctaaatatccgccttctcctctcactgcttcagaaatcagaccgtaaacagtcccgtttttcacaaggagggtcgggtggaactgggtgaactccatatccgtgatctcagctcccgcgcggaaggcaagagcgatgccgtctcccgttatggcggaatcatttgtgtgatattggtacagactgccgcagccgcctgaagcaagcactacacaatccgctcttctgtaagaaacggcacctgaagcatcctttacggcaacgcctgcgcatcgcccgtgttcaatcagcagatcaacaaccgtctcgtgttcaatgatccgaatgccgtccctcagctgccgaaccagaaactcaaccagcatccgtccggtcgcatctcccccggcgtgcagaatcctccttttggaatgagcgccttccctgccgagacaaaacgttccgtccgacttcgtatcaaaagggaaaaggccttctatcagcctgtttatcatgctctgtccgctttgcagcaaatgccgcacggctgtcacgtcattgtgtccgcatcccgcatacagtgtatcgttcacatgggattctatcgagtcatcttttgcgtatgaaacagcaatcccgccttgagcataatacgaattgctgttcgttacgtttctctttgtgatgacggttacttggtatgacggaggaaatgaggaagcacaggcaagggccgccgtccccgtaccaatgacgataattgttttttcagacatacatcaccctcccattatatttacacctgtcttgacacctatatttacacaacgataaaataaactcaagctttttttaacataaacggataggagacgggctgtatgatttatcttgattacgcggcgggaacgcctttaagcaaagaagccgcgaaagtctttcagcatctcagcacagaggtatacggcaatgctagcagccttcatgacgccggaggaagagcggcggacgtgctggaatattgcagacattctgcaggaaaattgatcggcggagcggcagacggcattcactttacaagcggcggaacggaagcgaacatcttggccgtccaatcattgctgtacggtctgcccgatcataaaaaacattttattacgaccgcaatggaacaccactcgatccataatgccgcggcgtttttagctgaccggggaattgatgtcaccatcatatatcccgacgaaaacggccttataaccgaggacatactggcggctcatatccgtcctgacacggggctcgtttccatacagcacgccaattcagaaaccggcctcatccagcctgtgaatcgtctggccgcttttcttcaccagagaaacattttactgcattgcgattgtgttcaaagtttcggcaaactgccgattgatgcggatcaggcgggaatcgacgccctttccgtctccggtcataaagtatacggcccgaaaggcaccggggctgtttacattcggccgggtgtcagctggaatccggtttatccgcataccgtgcatgaaaacgggttcaggcccggtacggtgaatgtgccggccatcggcgcttttaccgctgctgcggagtatgcagtgaaacatatggaggaacaccgtgagcatgctgacaggctgaggaattatttgtatgaccaaattaggcgtcaaggcctccccatttcattttcagaggaagaaaccggcggtgaatgcctgccccacattgtcgggtgtttttttcactcctttgaaggacaatatattatgttagaatgtaatcgtaacgatatttgcatctcaaccgggagcgcatgttccgccggcagccacggcccttcttcagctatgaaggcgctgagaaaaaccgaacgggaagcgcggcagtttttccggatctcattcggaaacgaaacaacatgtgaacagctcgatatgctgatacatacatttacggcgctatgggagcaaaagaaaggagaatcagcaatttgacagaaggaacgaagcttactggggcgaaaagacgcgacatgctgcttcattggctgaaagaagccggctcgccattaacaggaggcgaattggccaaaaaagcaaatgtttcaagacaggtgatcgtgcaggacatatcgctcttgaaagcaaaaagcgaaccgattatcgcgacgagccaaggctatttatacatcagcatgaatgccggcggcgaaaaaaacgccgaacggattgtcgcctgtctgcacggcccggagcggacggaagaagagcttgaactcattgtcgatgaaggcgtcaccataaaggacgtcattattgaacaccccgtatacggcgatttaaccgccgccataagagtcagcacacggaaagaagtcaaacaattcatggatcacattaactcgacaaatgccgcttacctttcacagctgaccggaggcgtgcatctccatacgttaagcgccccgacaaaagagcggattgaccaagcctgtcaagcgctggacgacgcgggtattttaataaaagattaaaaaaaaagccccctgaaggggagctttttttatatcgaataggattgatatgttcccagaagcttgacccggcagccgagggcttccatctcttgaacggcaccgggaatgagaacctgatccatcgcctgttcaatatcaataataaagaaatagttgccgagacccgttttggtcgggcgcgattcgatctttgataaattcaggtttctccatgaaaaagcggacagcaccctgtgcagcgcgcctgattggtcatcttggggaagcgttaccatcatcgtcgttttcggccgtgaagacagtttcgcattcacttcgaatgagacgtctttttcaggcgaaagaatgacaaatctcgtgtggttgtcctgataatcctgaatatcccgcttcacgatgctcaatccgtatgtagcggccgccatttcatttgcaatcacgccgatcggaaggtccgaatgctcactgacatacttggcagccgcacctgttgacttcgcatactcataaggaacggacgaaaaatgccggtgaagaaatttgtgacattgcgcaatcgcatgggaatgagaataaattttctcaagctttttccactcattttctctcgaagggtgaacgagcagatgctggtgaatcggcagcgtcatttcccccacgatcgcaagaggctgctcatgaatcaagtagtcaatcgttaagttaaccgagccctccagcgcgttttccaaaggaacaaatgcaagatcaacttctcccgcaaccgccgcatccatgcatgccggtattgtttgataaggtgcttgtgtcacgctgttttgaaagcaggaactgactgctagatgtgtaaatgtggcttctggccctaaataaccgactttcatgtctcttctctccttacgcgcctgaccctaagatctcaactttttctataaaatcaaattttctcagtttattcattaacgtatgaatgttttcttccattgcggacgtactgattgagagcgtgacattcgccctgccctgaagcggaatcgtctggtgaatggaaagcacgttgcttcctgagtcagccaccgcctgcaaaagctgggataacgcgcctgaccgatcctccaaatgaaagaaaagtgtgattatttgttctttaaccatcgtgtaaaaagggaaaaccgcatctcggtatttgtaaaaagcgcttctgcttaaatcaactttctgcacggcatctgcaaccgattcagccttttttctgtcgagcagctttttgacttcaagggttttccgcatcgcatcaggcagaacgtcttcacgcactaaataaaatgtctcttctttcacctgcacccctcccttttacatcagagagcctgcattgcaagctctccgtctttttaatcaataaattcaaattcaaattccagcagccggatgatatcgccgtctttagcaccgcgttctctgagcgcttcatcaacgcccataccgcgcatctgtcttgcaaaacgcttgacggattcgtcacgggagaagtcagtcattttaaagagacgttccagactgtcacctgaaagcacaaacgcgccgtccggatcacgggtaatgtcaaatggaatttcttcatcttccatcgtgtacattacacggttttccgccagttcttcttcatcatacagcgggaattcaggcgttgtttccagctggttggcgacttcaaacagaagatcgcggagtccttctctcgtcaccgcgctgatcgggaagacaggatggtcatcctgaagcttttctttaaacgcttttagattttcagccgcttcgggcatgtccattttattcgcaacgataatttgcggacgctccgtcagccgcagattatattcactgagctcctgattaatggtcacataatcctcatacggatcacggccttccatcgctgacatgtcaatgacgtgaacgatgacgcgcgtccgttcgatatggcggagaaattggtggcctaagccgactccttcgtgcgctccttcaatcaaaccgggcagatccgccatgacgaagcttcttccgtcatccgtttccaccatgcccagattcggaacaagcgtcgtaaaatgataatcggcgattttcggctttgctgatgaaacgacagacagaagcgtagattttccgacgctcgggaagccgacgagacctacgtctgcaagcactttcagttcaagcacgatatagcgctcttttccgggctctccgtgttctgacagctgcggcgccgggttggccggggtcgcaaagcgggtatttccgcgtccgccgcgtccgccttttgcgatgacggcgcgctgcccgtgctctgtcagatcggcaatgacctgttttgtatcgtcatccgttacgactgtgccgggcggaactttaacaaccatatcgtccgcatttctgccgtgctggtttttagacatgccgtgctcgccgcgtatcgctttgaaatggcgctggtaccggaagtccatgagcgtgcgcagtccttcatcaacctcaaaaacgacgtcgcctccattacctccgtcaccgccggcaggcccgcctttcggcacatatttttcacggcggaacgcaaccattccgttaccgccgtcgccgccttttacatatactttcacctgatctacaaacataatatcctccgttctaaaccgtaaaaaaccgctagttcattccaatttcggccacacattcatggccggtcagctcaaattgcatgacatcaaagtcctcataccgggatttgcgaaattcatcaaacacatctgcatttgcaatcgttccatgaaaatcgagatatacaataagctgtctgtcagggtgatccgtctgcagcgatacggtcagatgattttcactttcattgcttaccgccagaccgaacagatgaaacagttttctcatcaggttcgacagcttttgatcatatgccgataaatctttaatttctccgagcacttcgtattcgagcctcatataacgggacttccaattaaatgtcagaaagtcaaacgccaagtgcggggttttcaggtttgagagctttgactcgtgctttgcatctatgaccatttcgtcgattatttcaacgaccctgtcatacttctgcaaacttaagtttccttttatcagctgcagcttattcatccaatcatgacggaaatggcccattaattggatcagttcattgatcagagccgcatcgcttacaggttcttcttgtttcttcgatacatccttcattttcgcactcccaatcgtttaatttctttttaggagtcttgataagtgtgtactatgaattataacagagaaggctttgttaaaaaaacacttgtttttcctggttcatcatgttcctttttcggatcgcatacaatgcggatgccaggcagaaacatttttggtatcactgcttggggaacatatccagtgggtatgagaagctgatgtcctcattcaaggcggggttcactcacgcatcctctgcttttcattcttgatgttactccgcttactgcaaaaaaaactccagtcaacgaccggagttttttgtgtcattattgagctacaggatatacgctcacttttttgcggtcacggccgaaacgttcgaatttaacagttccgtcgattttagcaaaaagagtgtcatctcctccgcggcccacgttttcacctgggtagattttcgttccgcgttgacggtaaaggatagatccgcctgttacgaattgaccgtctgcacgtttagcgcctaaacgtttagattcagagtcacgtccgttctttgtagaacctacaccttttttagaagcgaaaaactgaagatctaatctaagcatgtaactcacctcctatatttggtttgcagtcaaccgtaagtgttcactgtaatcccgctcgatcgtttcaagagaaacaatcatgccttcaatcagcagctgcgctttttgcaaagcttcctgatcagcggcttcagggaattcaaaatagaaataacccccgtcctcgcctatatcaagaatcggttcgagaggagccagcgcgataaccgcattgaccgctccgaaaacgacagccgtgaccccggcgcaaacgagatctcgtccatgttcagcaaaatcggcatgtcccgtcatttcaaaggacaaaatgcccccgtcattccgggatcttcgaattgttgcctcaatcatgcttacgcgttgattttttcgattgtcaatttagtataaggctgacgatgaccttgttttttatgaacatttttctttggcttgtaacggaaaacagtgatttttttcgcacggccttgtttttcaactttagctgtaactgtcgcgcctgcaactgttgggttgccgactttcacgctgtctccgccaacaaacaatacgtcttcaaacgtcactgtttcacctgcttcagcagcaagtttttcgatgtaaacagtttgaccttcttcaactttgatttgttttccgcctgttttaatgattgcgtacattctctgcacctcctattagactaagactcgccagcaacaggggctttaaagctcttatcacctgtcccgagcggttgtagcattggtgctacatccataacattaaaaaatatatcagaaccaaaaggatatgtcaatctatttctagtaaggcagcagcaggtcttccatagaggaatctgtccgtttatcggcaaaatacgcatgaagcacttcattttcatcgagctggctgagcttttcgccggctttttcaatgataatggggtgcttgcatccccgtttgaattcagccatgacatgctttactttggcatcggccgcgaccgtcaaaggatgcagcatggcgacatcgcggtttttgccgtagtatctctccaaaagaaacctcagctgaatataatgccgcttccggtattcatcccataaagaagcggcgagaaagacgaacagcacccatgcgctgacctgaagggggacggccagcacaatccagcagcagagcaaaagcgcggaaacggccgatgtctgcaggctgaggagatgcgctttttgaaaagccatttgtttagagaagtataaaaacacgaacttgccgccgtcaagcggccagatcggcaaaagattgatgaaaagaatggagaggttataaaaggtaaacatctcaaatgtctgctcacttgcaaaacctgacgtgaaaaagagccaggctgccgcctgaagccacacatgctgaagcgggcccgccaaaatgaccgcgaattcctctttaagcggccggtttccgtgctcctccacctcaaccgtcccgccgaaagggagcagaaagatgcgtttaatgcgccacgaaaaaaacacagccagagcagcatgccccagctcatgaacggatacgaccagcaaaagacacagcagcgctttgatgtgccccgtcataagaccgagccccatgataatccaaagaaaaggatggacatgaattttaaaaaggaggatgagccatttattcatcaaatgtgatcacctggatcggatctatgaatttatcgccatcctggatcgcgaaatagtactggcctttacttttatcgttgagcttgatcgaaccgatctttttccctttatcgacaaaatcgtacaatgaaacgttaacatctttcagccggccgtaaatgctgcttgtattgtcggcgtgctgcaccttcaccgtcagccctgtttttttatctttgctcacttccataatgtagccttcttttacgctgtcaatggcttcactggcggtttcgacgacgacgccctctccgttattttgaaagtcctgctggattttccccgcggcaggaacggccatatcctgactgaccgccacctgaccgtccttctttttcgttcccggcgtaagaaaagcgagcgggtttccgaaggaagatacgaaccaattgcttacggcagcaaactgaaattctttttgaaaggtttgtgcgattgccggtttgatctgactcagcggctgtttgtcagttttataggcaatagcggagatcagtacgagacaggcggccagcaggcattttaaaataatagaatgagcgctgatcaatggatgccgcccgttaaattcgggcgggtgttccgtttgatattcgtagtccggaagaagcttgtgcttttcctgctccttgaccgtctgccacgcgggaaaattctgcgtttgagcgttttgaacgaaagtccgttttgattcaggccgctgttttcttcttttggccagtctttttctaatttcatcagctctgtgactcatcgccatcatcctttgcaatcgttgggtttgtacatcctatgtcttgtccattgcaaatatgcgctcttaaaaaacaaaaaagacctgataagctgggcttcatcagatctttgtattctggtatatattatgaacgcacgccgaaaaatgacttgattttcgccatcatccctttttgctgctcttcaagcacctgcaaaggaacggattctcctaaaatgcgccgggcgatattgcggtacgcaatgctggcgcggtttttggaattcatggcaatcggttcgccgatatttgaagccctgatcacttcatcatcgtcagcaacgattccgaggagatcaatagacagatgatgaacaacctcatccacatccatcgtgtcaccgtttttcaccaggtgatttctgatacggttcacgataaggcgcggcggttcgatatcttcctgctccaaaagtccgataatgcggtcagcgtcccgcaccgctgatatttccggcgtcgtcacaacaatcgccttatcagctccggagacggcatttttatagccttgttcaattcccgccggacaatcaataatgacataatcaaattcctgcttaagctcctgcacaagcgatttgatctgctcagggacaacagccgtcttgtcgcttgtctgggcagccggcattaaatgaagcagatcatcaaaacgtttgtctttgacaagcgcctgatgcgtcttgcatcggccttcaattacatctactaagtcgtaaataattctgttttcaagacccattacgacatcaaggttgcgcagtccgatatctgtgtctaccaaacagacgcgcttccctaaaatggctaaggcggtaccgaggtttgcagatgttgttgttttacctactccgccttttcccgaagttattacgatagcctcacccaatttcacattcctccctcaagccttgttagatcaggtcttaaatgagccaattgctgaaggcgttcaatgaccatatttccgtcagtatctaaataagcacattccatgtcgttccctttttgaatgtggtctggggagcgatttaacacgtgattgatcctcaattgtgtcggcatcatttcggatgcggcgatcacagcccggttatttccgttataacccgcgtgggcaatcccttttaatgaaccgagaacaaatatatttcctccggctctgatcgtaccgccgggattcacatctccgattaaaagcaaatctcccgtcacgtgaagcacctggcccgaacggacgattttggaaaccgaaacaatttcctgctcctctttcatccgctgcgcttcttctttggcgatgacttcactgtcaattgaatgcacgactaaatctttctttgacgcgatcagatcagtcagctgctctgcctgttcctgatacagataccgatgcccgagtttaatatgaacactgattttttggcctttgccatcagtatattgttcaatcgacagcatgttttgaagaccatcgaggagctcatcaaaagaacacgcatcatccagatgcaatgttaagccgttttttgttccttttattgttacatattgctgctttttggtcttcatcaatgttcacctcaacaacatactcttttcgtcaaaaaaagataaaatcctttttactcatctcttaattctttcttcagacttatataaaacagcctgaagggcaggactaatataacggctcccgcgatattcagcaaagcggtcggcaagaatcgctgaatgacaaaatcgttaaacgtcatagtgccgctgcggattaacgtctgaatgccgtagacgtaaaattcaagcacacatacgctcagcaccgcgaccagaatgaccatcagggcgtttgtctgcagcactttaaacgctttggccgccagatagcataatccggcaaaaccaaacatataaacgcctaaaacacccgtataattgatgtcataaagaaatccgaaaatgaaaccgtagatcaccgcatgcttttggttgatataagccgacataaaaatcagcgcaagcaaaagaaaatgcggaacgacctgctgctcgacggaaacgaaaggaaaacgcaccagatcggtatagatgctttccgcacaaaagaccaaaatcataatcaaagggagaaggaaacgtttcacgatccttcctcccctgttgctacgcttcggttcacgacgatgacatggtcaagatcgtacaagtcggcagccggtttcacataagcgattttcgtcaggccgtaagcatctgattctacatcggtcacttcgccgaccgtcagcccttgaggaaatacgccgcccgttccggaggtctccacgaggtcgccttttttcacttcacgtttttcatccggttcaaggatggtcattttcagggtctgtttctttttatcatacccttcaattaaaccgtagcctttgcttccctttttgccggagattttggtggccactctgttattgcggtcaacatcgctcagcagctgaacggcggatgtgaaactgttgagtccgctgcttttgatcttcccgaccagcgcacccttttcgttcgtgacagccatgtctttggccactttgtgcttcgttcccttattgatcatgatctgcttgtaccattgatcagggtttctggcgataacggtcgctaaaatcggatcatagtcggaaattgatttgacatgcccgagttcatcacgcagcttcttgttttcatctttgagttcttggagcttcgcttcatattgtgtctgtccgtccagcttttgtcttaagcgttcgttttctttgtacgtgtttttcaggtcttttatgtccccgaagaaccctgcaaaatattcggcaggcgtgtgaaaaatgttttgaaatactcccgtcgtatcaccgatcagcttttcaggccaggtggtattacggccgttcttcagcgagaatccaatcatagccaccaatatgataatacacagaagtaatagcattaaccgtttgttcggcatcgtgatacacctcttctatttaactcctgattatcttgtttttcctttgaaaagatggatgtgctccagtgcttttccagtgccgatcgcaacacaatccagcggatcttcagcgataagaacaggcattttcgtttcgtcgctgatgactttgtcgagattgcggagcagggcgcctccccctgttaatacaatacctctgtccataatgtcagcggccagctcaggcggtgttttttcaagcgtgctcttcaccgcatcaacgattgagagaactgtatcacgcagtgcatttgcaatttccgttcccgtgatttcgatcgttttcggcagacctgtcagaagatcgcggcctcggatttccattgacgcattttcttcaccggtttctgctgaaccgatttccattttaatggcttccgccgtacggtcaccgatcatcagattatatgtttttctgatatagctgatgattgagtcgtccatttcgtcaccggctacgcggattgactgagacgtgacaatgccgcctaaagaaatgatcgccacttcagttgttccgccgccgatatcaacgaccatgctgcccgtcggctcccataccggaagattcgcaccgattgctgccgcaaacggttcttcaatcggataagcgtcacgtgcgcccgcttgtcttgtcgcgtcgatgaccgcccgttcttcaacggccgtaatacctgacggcacacacaccataacgtacggctttctcgcaaacaatcctttatttttcacagcctgattaatgtagtatttcatcattgtcgcagttgtttcatagtcagcgataacgccgtctttcatcggacggagcgcaaccacgttgcccggagttcttccgatcatgtttttcgcatcgttaccgaccgcaacgattgacttcgtatccgtttgcagagcaacgacagacggctctctcactacgattcctttacctttaacaaacacaagcgtattcgcggttcccaaatctataccaaggtctcttgtaccaattccgaacatatgtatgtatcttcctttcttaaagcaaaaataccctaaagggaaaaactcataaaatctattatatcttaaatcaacgaaaaaaaaagtgttacaaatatcctttttcctttaaactcacaaattttttatcaccaatgaccaaatgatccagcagctcgatgccgattaaatttccgcactcaaaaagccgcctggttacctctatatcttccctgctcggtgtaggatctcctgaaggatgattatgaacgcaaatgaaggacgcggcggatcgtttgaaagcttctttaaacacctcccgcgggtggacaatagatgaattcagacttccgataaaaacggtgcgtttatgaatgacttgatttttggtatttaaatataaacagacaaaatgctcctgggttaaaaagcgcatatcctccatcacatacttcgccccgtcttccggagagcggatgacgcaatgctccccggcggatgtcttatgaatgcggctccccagctcaattgcggcaagaatctgaacggccttcaccgttccgattcccggaatgctggaaagctcctgggcagaggcgccttttaacaggcgcagcccgtcaaacgtccgcagcagccggtgagcgaggttcatgacggactcatgtttcgttcccgtccgcagcaggatggcgagcaattcattgttagagagatgttcggctccgaagtgcagaagccgctctctcggtttttctttttcggggaaatctcttaattttaacggcagatcacggatgatcaacccctccttgttccccttcccggtttgaacatcaagcttttatattaaattctttcaaggctctcattgttttagcgacaggaagcccgacgacagaataaaaatcaccgtctatttttttcactaaaagcgcgccttttccttggatgccgtatgcacctgctttatccatcggttcttttgtttcaatgtagagctgtatgtcgtcttcactgagcggccaaaacgtcacttccgttgtgtcacagaatgtttctttccggtcacgcgtctgaatgctgaccgccgtaatgacttgatggcttcggccggaaagcctccgcagcatctgtgccgcttcttccctgtcacgcggtttgccgaggcactcgccgtctatgcacaccatcgtgtcagccccgataacgactgcatcgggattttcggccaatacagcactagctttttgctcggccaaacattggacgttttcttccggcgaaaggtttcgatttaatttttcttctgtgcggctcgcaataatgctgtaaggaatctgaagaagattaaggagttcttttcttcgcggagattgtgatgcgagtattaagcgttttgtcatggttgtcatcctttcagggtttgcttaagaaaaaaagatacttgtctatcctaccaaatcaaacgggcaaccacaatttcagaaaaataactttttgatgacaaaataaaaaatcccgccggatgacgggaaatgagatactattttacaacacttaatagctctttttgggctttccagccggattccgaacccgacgtttccagttctttcagcgcttgaagcacggcctctttctgctttttgtcagcggcgtctgcgccgtctgccgcttttgccgcttcagccacttccgtttttgaaagatttttgccggtaatcgctttggcggagagctcagatgcctgtttaaaagagtcttccagccctgaatcgaccgcaaagctgagctcttttccgccccaagcctcaaaatcatggtctatcagtgtctgacccaattgctgtgataagcttttttccgctgcaagcccggcgatcacgtatgtgtatccgtcttcttttgccagagagacggccgagtatcctttttcagtcagctggtcaacaagcgtttgcgctcctttttctgatgaaaattttccggcctgcaccgcatatgttttatagtttcccgctgaagattccgcatctcctgtgccggctgtttcagatttgtcgttagaaacatctcccgctttcaccgtctgcccttgtgaacctttgtcagctgatgccggagcggaggcttctttacttcccgacatatttaaggcgacaaggccgagcccggtgcctaaaacagccgcaacggcaattgtcgtgaccgcttttttaactggagaagacggctgcttttttttcggaaaatgagggcctgtttttttcttctggtatggcggaacgactttcgggtcatcttcaaatacctcagaattcttctcatgatcccaattgaaatcttcttctttcggatcttcatgggaagcggcggtctcctgttccgccttttttgtttcttcccaattggaaaatgtgacggtcttctccccgccttcattcacatcttcttgtccatacatcgtttcttcttgtccgttaatggttactttaagggcattgtttttagctttgctgtgctttttgctcttcctttttttcaacgtctcttcccccttgcattcgtcttggccgtaccttgaactgatcatggttcacactttagcataggcgaaaaaaaaaagaacaagacttttgtcgtcttgtccaaaaaacgttcgccaaatttttcaagccccgcctgaagcgagcttgatgtaaaacgaaaacagctcatcaccgtataaataactcaaagcgctcccggctgagatggccggcgcaaacggaaatggctgctttttaccaagactgccccgggctgcagcgcacataccgtataccgctccgatcataacggaaagaaagaatgcaatgagcacgagcttcacgccgagcgtcaggccgatcaccccaaacagtttcacatcacctgcgccgatgcctcctttactgacaaacatgataaaaacaagcagaaaaaatccgcaaacggctccggcaaaccctgcataccatgaatccagcggagaaaacattcggccggcgatgaaaagcggaagaaaaaacagcagaactttgtcaggaatcagcatatattgcagatccgtcatagtaacaatcatgaggagagacagaaataacagcgcgactaacagttcttttgagaaaccgaaatgaatgcctgcagccgtgaataaacacgccgtccagcattccgccgccggatacataaccgacagcttcgcacggcagtttctgcatctgcctctttgcagaatataggagacgacgggcacaagctccccccaggagagcggcaagcggcaaaacgaacaggatgaacgcggcgaaataaccgagattcgcagcgggatacggcacgctgctgtataaaaaaaagaaccgaaaatcaagccgagaaaaaacagaattaaaagcactcagaccacacctttactatcaatctggctcagattatagcaaagaaaaacaccatgactgaaatggctgaaaatatattttcagcataaaaacacccggcaaaaccggaaaatggtctgccgggcatccgagaggctgtcagataagccgctttctcatctctgaaataaaatataaggagccggtaatgatgatgacatcatccgccccgtctttttgttctatccattctttcacactgtccgggttctcatcgaagctcttagatgcaagactgcttgcattgtaaagggcttcggcgcttgaagcacgcggaaagtcaaatgatacaaagtgaatggaatccgcttcggtttcaagctttttaatcatttcctgatacggtttgtcttttaatgcgctgaatacgacatggacgtttttaccggcaaagcgctgccggatcgtttctgtcagcgtttcaacaccctcttcgttatgggcgccgtccgcaaacactaaagggcggctttgaagacgttcaaaccggcccggccaggaagattttcccagtccgtttcgcatcgcttcttctgaaatgactgcggcctccaggcgattcagccattcagcggccaatatcgccaatgccgcattctgcctttggtgaatgccgatcagcgacgtttgaatgttttcatagcatttcgtttctgtttccagcgaaaagctttcgccggacggaagcgccgcttcattaaacagtctgcacgttttatatagtgactgatacggagcctgctttttttcggcttccgcttcaataacgccgagtgcttccggctgattgacgcccgtaatgaccggaatggaatttttaataataccggctttctgcccggcgatctcctcgatggtattgcctaaaatggccatatggtcatgtccgatacttgtaatgaccgacagaagcggtttcacaatattggttgaatcaaatgtgccgccgagccccgcttcaaaaatgacaaaatcgatatcagcccgcttcgcaaaatataaaaatgcacacgctgtaatgatttcaaattccgtcaccgttccggcatcggtcttatcaagctcatcgactatcggttttatgtcattaacgagcgttctccattcctcatcggtaatcggcgtgccgttgacgctgattcgctcattaaacgtaatcatgtaaggcgatgtgaacgtgccgaccgtataaccggcttcttgaaggacggaacggataaaagaaacggttgatcctttgccgtttgtgcccgccacatgaatggcgcgaatgttcttttccgggtgttccagtttttccatcagcttttccatacggagaaggcccggcttaacgccgaacttgagtctgccgtgaatccagctgatcgcttctttgtacgtattaaacaatgaaatcccctcttttatacgacaaggcggtttcttaggaaaccgccccgctgttttatcagcctttcagctctgcaatccgctgccggacagcttcgcgttttgccgtgtagtctttctcttttccgcgttcttcttcaatgacatgctcaggagcttttttaatgaatccttcgttgccgagttttttctgaacgcgttcgacttcttttgtcagcttgtcgaattctttttgcagacgggcgatctcctcatcaatgttaatcagcccttcaagcggcagaatgacttccgctccggtgacgacagctgtcatcgctttgtctgccgcagcgatatccgtcccgattttcagcgtgctcggattcgtaaagcgttcaacgtaagaacggttcttctcaaggcggccggcaatgtcttcggtagatgttttaatgtaaagttcaacctgcttgctcatcggcgtgttgacttcgctccggatattgcggacagaacggattaattcaacgagcagtttcatatccgccgctgcctctttatccgtatgttccggcaccggaaccggccaagagctgatcgtgattgactcgccttcatgaggaaggtgctgccagatttcttccgttaagaatggcataaacgggtgaagaagacgcatcgtctggtcaagcacgtatgccagaacagaccgggttgttttcttcgccgcttcatcttccccgtacagcggaagcttcgccatttcgatataccagtcgcacacatcgtcccagataaagttgtacaggtggcgtccgacttcaccgaattcataacgatccgcaagctgtgtcacgtcttctatcgtttcattcagtcttgtgaggatccacttatcagcaactgatttttcaccggacagatcaagctcgtcatacgtcatgccgtccatgttcattaatgcaaaacgggaggcgttccaaattttatttgcgaagttccatgtggattccactttttcatagctgaaacggagatcctgtcccggtgaacttccggttgccaggaagtagcgcagggaatccgctccgtacttgtcgatgacatccatcgggtccacgccgttcccaagggatttactcatttttctgccctgctcgtcacggattaagccgtgaatcagcacgtctttgaacggacgctcgccggtaaactcaagaccttggaaaatcatccgggatacccagaagaaaatgatgtcatatcccgttacaagtacatcggttgagtaataccgcttaaagtcttcagcgttttcatcaggccagcccattgtagaaaacggccaaagcgcggagctgaaccatgtatcaagcacgtctgaatcctgctcccaattttcgctgtcctcaggcgcctcaaggccgacgtacacttcttttgtttctttatgataccaagccgggatgcggtggccccaccacagctgacgggaaatacaccaatcacggatgttttccatccagtgcaggtacgttttctcgaaacggtcaggaacgaagtgaaccttctcttcttttgcctgaaggtcaaccgcagcatcggccagcggctgcattttgacaaaccattgtgtggacaggtacggctcaacaacggcgccgcttctctcactgtggccgacagaatgcatatggtcttcgattttaaagagaacgccggattcctgaagatctttgacgagttttttacggcattcaaaccggtccatgccgttatattgcagcgctttttcattcattgttccgtcttcattcatgacgagaatccgctctaaattgtggcggtttccgagttcaaagtcattcgggtcatgggcaggcgtgattttaacggcgcctgatccgaattccatatcaacataatcatcgccgacaatcggaatttcacggtttgtaatcggcagaatcaccgttttgccgattaagtgcttgtagcgctcatcttcaggatgaaccgcgacagccgtgtcgccaagcatcgtttccggacgggtggtcgcgatttcaattgagcctgaaccgtctgctaacgggtagcgcaaatgataaaacgcgccctgtacgtctttgtaaatcacttcaatatcggataaagccgtttttgtggcagggtcccagttgatgatatattcgcctctgtaaatcaagcctttctcgtacaacttgacgaatacttcacgcacggctttgttcagcccttcatcaagagtgaaacgttcacgtgaataatcgagtccgagtcccatcttggcccattggctgcggatgaaatcagcatactcttctttccacttccacgtttcttctaaaaacttttcacggccgaggtcataacggcttgtgccctgttcgcggagtttcgcttcgacttttgcctgagtggcgatgccggcgtggtccatgcccggaagccagagcacgtcatagccctgcatgcgtttcatacgcgtaacgatatcttgcagcgtcgtatcccacgcatgtccgaggtgcagcctgcccgtcacgttcggcggcggaatgacgacagaatacggctgtttcgtttgatcgccgcccgcttcaaaatattttcctttcagccaaaaatcatagcggcctttttcaatcgcagacggatcatattttgtcggcattgtttgttcgtttgtatccatgataaccctccagcatgtttagaaatggctgagcaactaaaaaagagccttcatcctgataaaggacgaaaagctctttcgcggtaccaccttttttcatgaacagatttgttcatgcacttaaacggataacgggtgcggcccgaatttctctactgtatgttcaagaaattatgctcccgggcgaccttccaatgagacggcataagaagcctttcagcacagtagcttctctctcttcatgcgtctttcttgtactcttcccgttcaaagcaggtgtatttatatcagctcatgatcttatttattatgttctttattatagtaaaagtgtttttgattcgtcaatcatcttttccaaaaaccgctgccgtcatacataaatgggcatgcaccccgctcttccccttacatacgatacatagaaaggcgaatgtgaggaggaattgcccgtgagaaaaaaattcaattcttattcgctcccccagtgggccagacaggtccgccttgtatccgtgcaagtcattattccgattacgatctttcaggggatcaggacgattttctttccgacgacttttgatgtcctgctgcttgccatcctgctgtttttagcgtgcgccctgcatttggaatggatataaaaaaacgagtcctgttatgaagaggactcgttttccgcttttatttttttctcccgctcaatctgatgaaccttcatgagaaaaggctcaacatttttcatctgccaaaacgctcttaataattgcgtgcactcttctttttcagagcccctttggccggtctgataccgtttcagcactttgtacatggcggacggataagccatatagctgagaaacagactgatttccgcttcacggagcgggaatgatttgtgatacgtataaaaccagtccagacattccggacatgctttcggatagcttctgaacattctggagtaaaagccgagcaggtcattttgcggagggcccagcgcagctttctcgaaattcgtgaaaaagcccgatcccgcatcattatacagaaagtggcggctcgataaactgccgtggttgatcaccgctctcgtcttgtcatgatcctttgccgcgtcaaaccattcttccagacgttccagagcaaaattgacggcggaaaccgtttctgtaagatacgtaacggcctgcagttcaaaaggtgaaaggtaccactctttttccgcccggtcggcgaattgttcatagacaagcttatcattttcccaatctcttttcgttgcttcataaaagccgctgatatcttcagtccggatttggatgtcccgcacagtcgcagaatggagcttcgcgacctctttaaaaaggtaaacatgtttttgatcccgttcttcctcctgatcgtactgaagccaaggcattaaataataagaattctccgtctgtctccccgcaaaaaaatcgccggcatacgtgcggcagatcggcacaaatgatcggtagcctttctcctcaatctcaatcataagatccgtaaattcactgctgcgggccggcttgagctgtttcaaagcaaaaatgccgtagtttgagtagaccttccaaacatgcgggctgacaggctcaatatactcagccgccagcccgtattcctgaagcactgattggactgcttccattccattcaccacatttttacggcctctttgtgcttacacatggctgttattatattcaggtatatacagaagctgaccttcctcaagctcgtcatcaaacgataaagcattcgttcggatgagctgctgggatgtaatgtcatatcgttcacacacccggtcgattgtatcttgctgctgcacgatacaaattttcattcttgaaaacttttcttcttcccttgtaaataattttgtcaagtaatgagagttgtcattttccttctgctcggttcccggtgccgcttcttcattctttctttcaggcttaagcggctcaggctgttcagcttgcgccggctcctcaggcggcagtttggaaaactgaaaagacaaatcgagaggcttcccggtttcctcctccggcggcgccatcttccttacctcaatttcaaacccttcttcaccatgagcctcttcttcaagcagcttaggagcgctgtaaaactcctcttcctgccgttccggaacgaactcgcgataaacgggcgcctgctcctcttgaaaaaccgcaggctcatcttcgtcttctgccgccttatgatcgctctgacggagaagcggctcggcctctggctgctcttctttttgaaggaagggctgttccgcaatttttggtttttctgcatgcggagtcagagtgaaagcagggaaaaccggttcgatatcatctttcggctcttcctgcacttctgctgaatcatcctcaaatacgggttcattcctcacagctgacatgattgcaggctcctcagcttcttccggctcttcttcgtgctggaaggaaacgggaggaggaggctcagtaaaggaaacaggtttaggcacctcttcttgctccctcagaatcggggctgcttcctgctcttcttcttcttgctccctcaaaaccggggctgcttcctgctcttcttcttcccgctccctcaaaatcggagctgcttcctgcgcttcttcctgctccctcagaatcggggctgtttcctgcttttcttcttcccgctccctcagaatcgggcctgcttcctgctcttcttcttcccgctccctcagaatcggagctgcttcctgctcttcttcctgctctctcagaagcggggctgcttcctgctcttcttcctgctccctcagaagcggggctgcttcctgctcttcttcctgctctctcagaatcggggctgtttcctgctcttcttcctgctccctcagaatcggggctgtttcctgcttttcttcttcccgctccctcagaatcggggctgtttcctgctcttcttcctcctgcctgagtaaaggcgggatttcttcctcgttcttctctgtttcttgtgctgcttcttctgatacagtcaaaggtatttcaggctcatggcgtatcattaattctggttcattttcgtcctcagaatgatgtccggcaagattgatcatttcttctctggaaaattcaggcgccacgtacaaagggatctccggctctttcggctcggattcctcaagcagcccttcaattgccaaatcagcttgaatggttaagatccttgaatccgtcagctgataatcaaaggcatcaataaatacgaaaacatcattgaggtggctcactttatttttcggaatcgtgatgtccaccgggaaacaatgaatgagctcggccgtgccatcctccctcgccctcacttcctctacatgcctcagctccctatcaagctcttcaaaatgactgctgtgatctatgttgtactcgccagtaagttctaatgatcctttaattgagacataatcatttacttcctgcaccctgatgtcagggtctaatgaaatcgaaagtaattcagaaacttcctgtcctttttggaaacagattgattcttcaacagaaaattgcaatcggtgattatgcggcaagttcatatcctcctttcatctaatccatacaattagatgtcactaaaggtgtatgccgcaatccgggaaaatatgataatggaggcattgaaaaaagccgatacaagtcttgcttgcatcggcttttcggtatcagcggctgatcgcctggaacactttctcagcggcttgaatggtattttcaatatcctccattgtatgcgcagtggagagaaacaatccttcaaattgagacggcggcagaaatacgcctgcgtcggccatccctttataatacttggcgaacagctttaaatcagaagatttggctgcttcatagttaatgacaggctcattggtgaaaaagaagccgatcattgaccccgcccggttaaacgtgtgcggaatgccgtgtgctgcagctgcttttgaaatgccttcttcaagcatatcgccttttttcacaaattcttggtaagattcaggtgtgagctgctgtaacgtctcaagtcccgctgtcatggcaagcggatttccagacaatgttcccgcctggtagatcggaccgctcggcgcgattcgttccataatgtcagcttttccgccatacgcaccgacaggaagaccgccgccgatgactttgccgagacacgttaagtcaggcgtcacgccgaaatacccttgcgcgcagttataatccacgcgaaaaccggtcatgacctcatcaaaaatgagcagcgcgccatactgttccgtaatgtcgcgaagtccttgtaaaaagccttcctgcggcggaacaacgcccatattgcctgctaccggttcaacaatgaccccggcaatatcttcaccgtactcccggaatgcgagtgcaacgctttccaagtcgttgtatggaacggtaatcgtattcattgctattccttccggcacgcccgggctgtccggcaggccgagtgtcgccactccggatcccgctttgatcagcagcgaatcaccatggccgtggtaacagccttcaaatttcaaaattttgttgcggccggtgtatcctcttgccagacgcagggcgctcattgtcgcctctgtgccggagctgaccatccgcacgatttcaacagacggtacacggtcaatgaccaatttggccagttcgttttccacttcagtagatgccccgaaacttgtcccgttctcggctacttttttcaggctttcaacgaccctgtcgttcgtgtggcccaaaatgagcggcccccagctcagcacatagtcgatatattcattgccgtcaatatcaaaaattttcgatcctttgccgcgctgcataaagatcgggtccatatcaactgatttaaacgcgcgcaccgggctgttcactccgcccggcatcagtttctgcgcttctttaaaagcggcttttgatttttcatagcttctcatctgcctcagctcccgtcaaatgaaatcgttactcagcaagccatttcgctgcgtcttttgcatgatacgtcataatcagatcggctcctgcacgtttcatgcccgttaaaatttccagcaccatttctttttctttaatccagccgttttgggctgccgctttcaccatggaatactccccgctcacattatatgcgaccagcggcaggtgatggcggtttttcacatcacgcataatatctaagtatgacatagacggtttgacgattaaaaagtcagcgccttctgccgcgtctgattcagcctcacgtagcgcttccaggcggttggccggatccatctggtatgtttttcggtcaccgaactgcggcgtgctgtcagccgcgtcgcggaacgggccgtagaattcacttgaatatttcacggcataagacatgatcggaatattcgtgaatccttctttgtcgagcgcttccctgatcactgtgacaaaaccgtccatcatatttgaaggagcgatgatgtcagcgccggctttagcctggctgacggctgtctgcgccagcagctcaagcgactcgtcattgaggattactccgtctttcacgaccccgcaatggccgtgatccgtgtattcacagagacatgtatcagcgatgacgatcatttcaggataatgctttttaatttcagcaatccctttctgcacaatgccatgatcgtgaaaagcctgggttccgcaggcgtctttttcttccggcacaccgaaaacgatgaccgacttaatgccgagcgatatcagctcagccatttcatcctttaacaaatcgagtgatacatgataaacccccggcatggaaggaacttctttttttccttcgagtccttcaacgacaaataacgggtaaataaaatctgaagggtgaagacgtgtttcttttactagatctctcatcgcagcgttcgcgcgcaaacggcggtgtctgttaaatgtttgattcatcattatctatcctttcccgacatgctgcacatgacgtccagcatgccttcaatcgtataggtgtcaggcacatgggatgagatcccgtattccaagagcgctttctctgtcaaagggccgatgctgatatagctcgcaccgctgttttcccacgctttttctccgtctccgaccgcgtgcataaacgtatgcaccgccgatgaactggtaaacgtaataaaatcaaaatgagagcgggatgcagcccgtctcagctcgtccatgcctttttcatcctgaatggtattgtataacacccattcccttatttgatagccaagcggctcaagctccgcttttatgacatcgcgtgataaattgccctttatcaatgaaacgggttcggcagctgatgcgtgccgttttaaagtatcagccagacattccgccacatactcgtcaggcatcgcatccgtccgggctccccgctctttcagggcgcgcgctgtcttttcaccgacggctgcgatttttttccgttccggaagcgcaaggccatgctgatcaaggtaggaaaaaaagaaccggacaccgtttacgcttgtaaacacaagccagcccggttcagaaaggtcttcccgcagactgtccgcacattcatccgggagcgcttcctgaaaagcgatcagagaggcggaaacagccgttccgccgagcgcctccactttttttcgaaacggtgctgcctgtcttttgttccgggtgacgagcacggtctttccttgtaaaggaaggtcatttgccatcctgttcgagctcctgtttcacgctgtcgattagtgctttggctcctttttcagacatcatcgccgcacagcgtttcccgatttcttccggatcatgtcccgccgctgtttctttataaatcgtctttccgtccggagacgcgacaagaccgaccaattcaacctcatcccggtcattgacggacgcatacccggctatcggcacttggcagccgccttccatcgcgtgtaagaaagcccgttcggctgccaccgtgcgctgcgtatactcatcggtaaattgcgcaaacagcttcaaaagctcttcatccgactctctgcattcaatggcaagagcgccttggccgaccgcaggcagacagcggtccggttcgaggaattccgatacgacatcatctttccagcccattctcgaaagccccgcagccgctaaaataatagcatcgtaatcttccgtttcaagcttttgaagtctcgtatcgatattgcctctgatccacttaattgtaaggtcagggcgttcagcaagaatctgggcgcttcttcttaaactgctggtgccgatgatgcccccttcttttatgccgtccagcttttgatgcccttttgaaatgagcgcatcacgcggatcctcacgtttcggtatgcagcctatgacaagaccctcaggcaaaacggcgggcatgtctttcatgctgtgaaccgccatatcaatctcctgatgcagcagcgcctgttcaatctctttgacaaacaaacctttgccgcccacttttgacagtgtaacatcgaggatgcggtcgccttttgtgacaatctcccggatttcaaagtcataggaaggattcaattccttcagtttgttaatcacccattttgtctgggtcatagccagtttgctccgtctggaacctaccttaatcgttctcattttctttcctcccgaatctgtttgggcgcgtgcgttaactgaaccaatggaattgtgacaggcttccgagcaggaagtaattaatcatcagcacgagaaaacatgctgaattccataacgccgccactttcccctgcagttccttaatcattctgatatataaatagtagctgtataaaagcagcacaataaacgagccgagcacttttgagtcaaaccagtacagcgtttccagcgacacatacgcccagatcacgcctaatatcaggctcaacagcagcatcggaaccccgatgacatttaaaacgtaagccatataatcaagttttgacaaatcttcaattctcaacagccattttccccattttttcttctttaataaagaatattgaaactgataaagaagcgaaaagacaaaagaaagggaaaaagcgccgtaagacagaatcgccattgtaatatgaatgaccaaaagctctgagaccagctggccggaaaaggcggccgaatgctgatccgtcggtgaaaacgtatggatcgcaatcatcgagaaaccgatgacattcgtgaaaaacacgataaaatcaacccgcagaatctgcgtgaccacaagtgaaagcgtgacaagcacccacgcataaaagtaaagggcctctgtaatattcaagaccggaaatctgcccgtctgccacatgaaataagaaagatagacagtttgcagagtccagacaatagaaagcaaccagaaggctatttttccagccttccggttgtgttgaagaaaatctataaagtaaaaaaggacgcttactgcataaataacaattgtcgcttcattaagtcttgccattgctgtatcaatcatacagccctcactcacttacaagcggacgtaagcccgtttttgcttctgccttttgaaacgaatgaaccgtctggcggttatccaggcttttgtccagctggcggccggcctcttcctcaatatcgaaaatctgcataaacagcttcagcttttcatctgaatccgcttcagccgcaagctctttcgctttcagaatcgggtcgcgcagcatttggttaatgatgcttttcgtatgtttgctgagaagttttttctctctcaccgtcagatgaggcagcttgcgctcaatgctctgcatcgtatcggactggatggacagcgccttttcacgcagcgccgaaatgaccggcacgacgccgagcgtattaagccactgcttaaactcaacaattgccgcttcaataaacagctcgactttttcagcggtttcgcggcgttcttgtaagttggcttcaacgattccttcaaggtcatcaatatcgtacagaaaaacaccttcaagatcgttaagcgccggatcgaggtctctcggcacagcgatatccaccataaataacggacggcctttccgctgtctgcccgctctctccatcatttctttagacacgacgaaatcactcgcgcctgtcgaactgattaaaatatcagcttcagcaagtgcatattcaagctggtttaagctgcgcgcttctccggagaaacggtcagcaagcgcttttgccttcaaaaacgttctgttgatgaccgttactttgccgataccctgaccgtgcaggttttctgcggcgagctcgcccatttttcccgcaccgagaatcaaaatgtgcttatttgacaatgagccgaagatttttttcgcgagttcaacggcggcgtaactgacggaaacggcattggagccgatatcggtttcggcatgcgtgcgtttgccgacggtcaccgcctgtttaaacagctcattgaaaatggtgccgatcgtcttttctgcctgcgccgttttaaagctcgagcgtacctggccgagtatttgcgtctctccgatgaccatggaatctaaaccgcacgccacacggaataaatgctcgatcgccgcgtcgctctcataaaatttcagaaacggagacagctcttctttcggcagcgagaaccattcggataaaaatgtctttatataataacggccggtatgaagctggtcgaccaccgcatatatttcggtgcggttgcaggttgacacgataatgttttctagaacgcttttttcttcttttaagcggagcatcgcttctgcaagctcatccggctgaaaacttattttttcgcgtatttcaataggggcggatttataatctactcccacaacaagaatatgcatcgctttcatgcacccccgtacatcgcaatttatttataatcattctaacatagaatttattatttataataattataacatagtttcttcgggaaaatgtgaacagatttcaaaaatgttatgctatagtataaaaagctcgttcccactgtaatcatcatactaaaaatcctttactgcgggtaggtgacaggatgaaaaaaacatcaattttattaccgggacttctgcttgccgcttcattatttgcatggcttcagagcggacaggttcacctgtttgcgaatcaggggaatggccggtgctccttatgctcttgggggctgtgctcttgtatcagggcaaaaaggaagcggccgggcctcacgtcctgatcggcatgcttcttttcggcataggtttacactttttcgccaaacctgagctctcatggtggccgggagattttgaaatgattctcttcgtcttcggattctccttatttgcggctgccagaaaagaatatgtatacgaagcggctgccatgattggtttttccctctttttatacttctttaaacaaattacggcgtggctggagtccgtccatattccgacggaacacttcaaaacatactggccgtatgttttcatcggaatcagccttttattattgtttatcaagcggaacaaaactatacgataaaacccaaaacgcactgcgttttgggtttttcattaccggctgatcatttttttaatggctccccatgcttcatctttgccttttttcgtttcagaggaaaataaaatcagctcatcttcaggatccatatcaagcgtctgtttgacaacctttaagtgcttgtcccattttccttttggaatcttatccgcttttgtcgcaatgacgatgacgggaatgccgtaatacttcaggaattcatacatgttcacgtcttcagcagacggcgcgtgtctgaggtcgacaatctgcacgcaggctttcagctcttcgcgggtcgtcatataggtttcaatcattctcccccatgcttcccgctcgcttttggaaactttcgcaaatccgtacccgggaacgtcgacaaaatgcaattcatcattgatgatgtaaaagtttaaagtctgtgttttccccggttttgatgacgttctggccaagtttttccgattgattaatgaattgataaaagatgactttcctacatttgatctgcccgccagcgcgatttccggaagccccccatcagggtactgttcgggtttgaccgcgctgatcacgatttctgactttgtgactttcatttcttctctcctactaaggcatgttccaaaacgtcatccaggtgagaaacgaatataaacttcagtccttctctgacgctttctggaatatcctctatatctttttcgttatctttaggcgcaataatagtggtcaggcccgctctgtgcgcgccgagcgccttttctttcagtccgccgatcggaagcacgcgcccccgcagcgtgatttctcccgtcataccgacttcgcgttttaccgcacggtccgttaatgctgaaacgagcgccgtggccatcgtaattccggcagaagggccgtctttcggcaccgctccttcagggacatggatatgaatgtcatacttctcatggaatttcgggtcgattccgaactgttccgctttcgaacggacataactgaaagcggcctgcgctgattcccgcatgacatctccaagcttccctgtcagaaccagctttccttttcccggtgacaatgacacttcgattgacagcgtatctccgccgaccgtcgtatacgcgagccccgtgacaaccccgatttgatcttcggtttccgcctgtccgtatctgaatatccgttttccgagatagtcggccagatttttctctgtaacggtaatgcgttttctctcctcagacacaatggctttcgcagcctttcggcaaatggcggcaatctggcgttcaagcgttctcacgccggcttccctcgtgtagtagcggatgatgtccgtaatcgcctgatcccgaatctgcaggttgctctttgtgagcccgtgctctttgatttgtttcggcagcaggtgatctttcacgatctccagcttttcgttttcagtgtagcctgacaggctgataatctccattctgtctctgagagggccagggatggaagcaaggttattcgcagtcgcgataaacagtactttcgataaatcgaacgtctcttcaatatagtggtcgctgaatgtgctgttttgttccggatccagcacctcaagcatcgccgaagacggatcgcctctgaaatcagacgacattttgtcgatctcgtcgaggagaaagaccggattttgtttgccggcttttttcatcccctgtataatacggcccggcatcgccccgacgtatgtgcgccggtgcccgcggatttcagactcatcgcgcactccgcccagtgaaattctcacaaaagtgcgccccatgctcttactgattgattttgcaagagatgttttaccgactcccggaggtccggccagacaaagaatcggccctttcagcgttttcgtcagctgtttcacggccaaatactccaaaatccgctctttcactttctctaagccgtgatgctctttatctaagatttccccggcttttttaatatcaagtttatcttctgtttcatccgaccacggaagggcgatgagccagtcaatatagttgcggataacagagctttccgctgagcttgacggcactttttcgtaacggcttaattccttaagcgccgtttctttgacacgctcaggcatgcctgcttcttctatcttttccgtgagcgactgaacttcgccggtttttccttctttgtcgccaagctccttctgaatggctttcatctgttcgcgcaaataatattccttttgagtgcgttccatcgaacgtttgacgcgctgaccgatttttttctcaatctccagcacttctttttcattatgaatggaacgaatgaccttattcagacgttctttaatatccgccgtttctagaatgtcctgcttgtcctttaatttcagcgggagatgagaagcgacgatatccgccattctgccgggctcttcaatatcagtcacagccgcatacgtttctgcggaaatttttttagaaatttttatgtactggtcaaaatggtccagcagcgtccgcataagcgcttcgtcttccacgtcttttgaatcatcctcatgcatcagctgtatatcgaccgaagtataatcttcgagttcggtgtattcaaggatctgcgcccgctgaattccttctacaagcactctgatcgtaccgttgggcagcttcagcatctgtttaatttttgtataagtgccgacggcgaaaatatcctcttcacccggttcgtctatcgaaatatcctgctgagtggctaaaaaaatcatatgatcatgcatcattgcctgttcaagagcctgaaccgacttgtcacggcctacatctaaatgtaaaaccattgtcgggtataccaataagcctcttaaagggaggagcgggatgctgcgttttgtatcttctgccatgtgactgacacctccgtgactttagtatgaaccattataatacaactttttcatcgttgtacaattccgggatcgggctttaatcggcttatccgcctgccctgtatataaaacagtctcttcgtagtataccctttctttctgttctgaaaaaggaaaagatgtcctccataaaaaaaccccattataaaaatggggtttatacggattctttattcatttggatatcaaacggtttttgttctgaaggagggtcaaccaatatgacgtcaagcacttcctggaacgtttttaccgctttaatggtgattccgtctattcgtttcagaatggactgctgattttcataagggataatgaccgtttttgctccggcctgttttgcggctttaattttcggaatgacgccgccgatcggtttgacaagccccgtcaggctgatttctcccgtcatcgccaccgtatggtcgatcgggatgcggtgaatcgcggaaaaaatccccgcggccatcgcgatacctgctgaaggtccgtcaatcgggcctccgcccggaaaattgacgtgaatgtcatagtctgaaggtttgatgcccattgtgcggagaaccgtcagcacattttccacagatcccttcgccatgcttttgcggcggatcgacttcgattggctgccgatgctttcttcctctgcaattcccgtgatattcaggcttcctttgtcctgcgcaggtgtgacattcacttcgatttccagcaatgcgccgctgttcggcccgtagacggcaagtccgttcacgatgccgacttgcggttcatcggcgattttctgctcatttttaggtgtgagctgactggaatgaacaacccattctatatcttcagtcgtgatttcttttctgtcctcagtcaccgccatgccggcagcgatctggatcatattgacggcttcacgtccgtttctcgtatatgcggtcagcacgctgagagcttcgtcagaaatctctttctgaattttgtcggctgcttttttcgcaacgattttaagttcatccttttccagctcgcggaaaaatacttcaagacagcgcgaacggatggccggaggaatttcagtcggcattctcgttgtcgctccgatcaaacggaaatccgccggaagcccattttgaaaaatatcatggatgtgattcggtatttgcgtattttcttcactgtaatacgcactgtctaaaaatacttttcggtcttcaagcaccttcagcattttattcatctgaatcgggtgaagctcgccgatttcatcaataaacaataccccgccgtgagcatgggtcacagccccctgtttcggctgcggaatgcctgcttggcccatcgcacccgctccctgataaatcggatcatgcactgaaccgataagcggatcggcaatcccccgttcatcaaatcgcgcggtcgtcgcatcaagttcaacaaaaacagcctgcttttgaaacggtgactgtttatgctttttcgcttcttccaataccaaccgcgccgcagccgttttaccgactcccggaggaccgtaaataatgacgtgctgcgggttcggtccgcaaagcgctgcttttaacgctttaattccgtcttcctggccgacaatgtcctgaaagcttttcggccgcaccttttctgataaaggttctgataaactgatggcgcgcattttgcgcagctgttccatttccttttttgattctttatctatcgtcactttttgtgttcgctggtttttgagcagattccaaaaatatagtccgatgactatcccgaaaaacagctgtacaaataatgcgatccctgtccaactcatgctggtccctcctgaaaaaacgatttatgtatccaattcattcctctgtccgctagtatctcccagcaaagcccggaataaacattttcagaagggtcaggacaagaaaaaaacctcctgattaattcgggtcaggaggttttgtcgtgttatgctgatgttttatcttggccgacaacagtaccgtcttttaatacaagacgcggcgcttcaccgtctgcgactgtcgctccggtaatgacacatttttcaatatcatcgcgggacggcagatcaaacatgacgtcaagcatgatgccttcaatgatagaacgcaggccgcgtgcgcctgttttacgctcgatcgcttttttcgcaatttcagataatgcctcgccttcaaattcaagctcgacatcatcaagttctaacattttcttgtattgtttgacgagtgcgtttttcggtttagtcagaatttcaaccagtgccgtttcgtcaagctgctcaaggcttgcaatgacaggaagacggccgatgaattcaggaatcagaccgaaacggagcaggtcttccggaagaactttagaaagcagttcttctttttccaggtctgccgctttattatcagagccgaagccgatgactttttgtccgagacggcgtttgatgatttgttcgatgccatcaaatgcaccgccgcaaatgaacagaatgttcgtcgtatcgatctggatgaattcctgatgaggatgtttgcgtcctccttgaggcggcacgcttgcaaccgttccttcaagaattttcagcagcgcctgctgaacgccttcgcctgatacatcgcgtgtaatggacgggttttcagattttcgcgctactttatcgatttcatcgatatagataatgcctttttctgctttttccacatcatagtctgctgcctgaatcagcttgaggaggatgttttctacgtcctcaccgacatatccggcttcagtcagagatgtagcgtccgcgatcgcaaacggaacgttcagaatacgcgcaagcgtctgggcaagaagtgttttcccgcttccagtcggtccgattaaagaaatattacttttagaaagctcaacatcatccactttactgttggaattgatgcgtttgtaatggttgtataccgcaaccgcaagtgatttcttcgcctgatcctgtccgatgacatattcattcagaatctcacggatttcctgcggcttcggaacgtctttaaattcgacttcttcttccgtaccaagctcttcctctacgatttctgtacagagctcaatacattcgtcgcatatatatacacccggtcctgcaaccagcttacgaacctgatcttgcgtttttccgcagaacgagcatttcaattgtcctttttcctcgttgaatttaaacattctttcaccccttaatcttgtctcactttttcttttacctgaagggcaaaagaaaacggttcttgctacgatcgagtatgtattgcattttaccatactttccagtaagacggtaacaatgtgtttcgcacttgcacattctatatgtatgacgaaaaacagcccggcaatgactatcttgccccaagaaaaagagttatatcataattgtacaaaacaaggcacgaattaatcgcgccctgttttattatgtctattattatgaaccatattaacggttttctacaagaaaatcaattgcttttcgaacttttaaatcttctttcatcgcgtcagttgaaccgattgcctgcttgatgttttcaaccggcatgttgtaagcttcagccattttagtcagctctgcttcaacttcttcgtccgttacttcaaggttttctgcttgagcgatcgcttcaagagtcaggtttgattttacgcgttttgcggcatcttctttcatttgctcttttaacgcgttttcgtcttggcctgagaattgagtgtaaagctcaaggttcatgccttgcatttgcagacgctgttcgaattctttcagcatgcggtcaagctcagtgtcgatcatcgcttgaggaacatcagcttcagcgttttcagatgctttcagaacaagctcttcacgcaatttagcgtcagcttcgttttcttttgcttcttcaaggcgtttttttgttttctcggttaattcagcaagcgtttcaacttcttcgtcaatgtcttttgcgaattcgtcgttaagctcaggaagctctttcgctttgatttcatgaattttcactttgaaaacagctggttttccggcaagctcttcagcgtggtactcttcagggaatgttacttcaacatccttttcagcgcctgcttcaaggcctgttaactgctcttcgaagcccgggatgaatgaacctgatcctacttcaagtgagtagttctcagcttttccgccttcaaacgcttcgccgtcaacgaaaccttcgaagtcaagaacgactgtatcgccgttttcaacagcgccttcttctttcacgacaagctcagcctgacgctcttgaagcgctttaagttcgttttgtacatcttcgtcagtaacggcagtgtcatctttttcgattcctaagcctttgtaatcgccaagtttcacttccggttttacagtcacttttgcagtgaaaattaagctttcgcctttttcgattttttcaacatcgatttcagggcggtctacaggctcaatgccggcttcttcaaccgctttagggtattctacaggaagtaaaatatctaaagcatcctggtaaagagcttcaacgccgaaacgctgttcgaataaaccgcggggaactttccctttgcggaatccaggaatagaaacctgttttactacttttttaaatgcatcatcaagagctgttttgaacgtatccgcatcaacttcaaccgttaatacgccttcgttgccttcttgtttttcccattttacagacatgtgtttccctccaaaaatctattcaggttgtgtcggtcttccattctaaagcaatccgcggctttgtcaaagaaaaaaccgctttgaatcagaatcattatgtaatgaactggcagcctgtccaaccgtaattctcatttcagttaaaccgctatacataaatacaaccactatattataacataacgcctaccgctttcaactatatggtgtgatttacaaataagaaatttcttcaatatccttaatcatcgtgcaggcttcttcgagttcgcggctgtcaaactcgtacatcatatgaagttcctccggctcaatgtcaatgccgtgcatctcgtaaccgaccttatgaagcgccgccgcccataaatccgcgttcaaaaacttcggcataaaagggtgcaggacgtacagatgtcttctccacagctcctcgacggcagcatataatgtagggttttcattgcccagcgtttcatcaagcacccggagaacgcgatgcaaaatcggagccgcatcaggctggaccgtttcactcggtatcgcggtcattgaatcgccgaattttgtaatatggaccggtttactgtagtcgtgctcggccatcagcgtcaaaatcattgtcttaataagaggatgcgcgcccggatcttgaagaatcgtttttaagagacccgtgtattttgcaatattgcggtctttaagagaatgaatcagattcatttgttcagcggggctgttcagcactttttccgtatcaagaatgtcctcgtattcctcctcccacgcctcctcctgctgatcgggatcggtcattttgcggctgaattcgagcagccggtagaattgctccgcactttctgcgggcagctggttttcttccagcacagcttcaattgtgcttttgacttcttcatattgtttcagctgaattaaaatggtcatgtacacctgcaatacggtgaaataatggccgtacccttcattcagcattttctcgcaaacttgttttgcttcttccaattccccgagttccagaaaacaaatcgccatgcctaaatgtacgtcggactcggtatcgccgtggcttaccgcctctgaaaacagttcgagggcctcctcatactgtttatccttcatggcggccatccctttatcaaccaagcgttctttcagacgggggaaaggaatgatatcagcttttttcttgtcatgcgtcatactttatttcctttcaggcgcttattttgttcaagtgtatcaacacgcgtcatgaaacacaagaaaggatgatgcacacggtaaaaaaagccgccggacagatgccgggcggcttttttcaggcttgaagccatgaacttcttttcgattcaaactgctgaatgtcgtcctccagcagaagcgttaatgaaatttcatcataaccgttaatcagcatttccttccagtgcggatcgacttcaaatgaaatctcttttccttcactgtcgtgaatgagctggttttccaaatcaaccgtcatatttagagactgattttcatattgaccggcgagttttttccactgatcatacggcatacggatgggaagcataccgtttttaaaacagttctgatgaaaaatatcggcaaatgacggagcaatgatgattttgaagccgtaatcatccagcgcccaaggagcgtgctcacgggatgatccgcagccgaaattctctccggcaattaatatggacgcgccttcatagactttgcggtttaattcaaattcaggatcaggctcaccgttctcaaggtatctccaatcaaaaaacgcgaatctgccgtatccggttctttcaattcttttcaaaaactgtttcggaataatctggtccgtatcgacgttgatccggtttaagacggccgcttttcccgtatgcgtttttaaaggttccatcttttcgcgcactccttacacaactgttttttcttgataaaactttcttacatcgacgaaatgcccgtgaatggccgccattgccgccatcgccggactgacaaggtgtgttctcgcgccttttccctgtctgccttcgaagttgcggttggaagtggaagcgcatcgttccccttcaggcacgacatcattgttcatactgaggcacatgctgcagcctgattccctccattcaaagccggcctcgagaaacacgcggtgcagcccttcttcctcggcctgctgtttcacgctttgagaacccggcaccacaatggctctgacgctgtcggcgacttttcggcctttgatcatatccgcagcctggcgaagatcggtcatccgtgaatttgtacaggagccgataaacacatgctcgactttaatatcttcaattttttgattcggcgcgatccccatgtattcgtaagcgcggatggcttcttttttaccgtcttcagaatcaatcgtttccggcgcaggtatttgggcatcgaccggaagaaccatgccgggattgacaccccatgttaccattggagaaatctcgctgccgtctaacacgatggaatgatcgtatacggcgcccggatcggtttttaacgctttccattctgcggcggctttttcaaattcctcgctttttggcgcgtatttacggtttttacagtattcaatcgtcgtgtcatcaggagcgatcagtcccgcacgggctcccgcttctattgacatattgcagacagtcatgcgttcgtccatagacatgtttctgaatacttccccggtgtattcaatgacatatccggtaccgaatttcaccccgtattttccgatgaccgacaagatgacatccttcgctgtcactcctttttggagcgttccgtcaacgcggatttcaagcgttttcggccgctgctgccataatgtctgtgtggaaagaacatgttccacctcacttgtgccgataccgaaggcaagcgctccgaacgcgccgtgagtcgatgtatggctgtctccgcaaacgatcgtttttcccggaagtgtcagaccaagctcaggcccgaccacatgaacgattccctggtctgcgctgtgaagatccgcaagacggacgccgaactcctcgcaattccgttcaagcgcggttacttggcgctttgcgacttcatctttaatgtcaaaacggttgacggtcggaatattgtggtccatcgtcgcgaacgtgttctgcggccgtctgacctttcttcccttctgccttaacccttcaaacgcctgaggagacgtcacctcatgaatgaggtgcagatcaatatagagaaggtcgggttttccttcaccgctttttacaacatgccgatcccaaatcttttcgatgattgttcgaggcatcatctttgtttcctccctctacctattgaactaagaccgctttctttaaagcgtcatactatagattttgtattcgagccggctaatgcggcttttactttttcagtaatgtcatgcgttccggcatattggccgtcccgggcgatatcacgtgtacggctgccgtctgcaagcacctttgcgaccgccttttccaccgcctgcgcttcgttttcaagtccgaaagatgttctcaaaagcatcgccgctgataaaatcgccgcaaacggattggccatccctttaccggcgatgtcaggcgcagatccatgcacgggttcaaacaagtgaagacctgaacttgataaactggctgacggcagcatgccgagcgagcctgtcagcatggaggcttcatcgcttaaaatatcgccgaacatattttcagttacgatgacgtcaaactggctcggagcgtagatgagctgcatcgcggcattatcgacaagcatatgttcaagcgtcacatcaggaaattcttttgcgatttcatctgccgtttcacgccacagtctgcttgaagaaagcacattcgccttatcaacggacgtcacttttccttttctgccggcagccatcttaaaggcttctctgacaacgcgtgcgatttcttctttcttataaaaaagggtatcgaccgcttccttttctcccgcttcattgacatactgtctgctcggttctccgaagtagaggccgcccgtcagttccctgacgattacaaagtcgacgccgctgatatattcttttttcagcggagacgcctcagacaggctttcaaatacggtcacaggacgcagattggcaaacaggccgagcttttttctgatgccgagcaggcctttttccggtctgagctccggagggttttggtcccatttcggcccgccgactgccccgagcaggatggcgtcggatctttcacaaagagccaccgtctcctcaggaagggggttttgatgggcgtcaatcgctgctcccccgatcagcccgttttcaaattcaaattcatgtccgaattgttcagcaacgcttttcaatacatctgccgctgattccgccacttccggtccgattccgtcacctggaagcaaagcaatgcgttttttcaaatcaaacgttctcctttctattacgagccgaccgcagtccgtctctttaatccgtctaaattgcaatccagcaccaactgccgattcacggcgttcagataagctttagcagaagcttccagaacatcctgcgcgattccccgccctgatgtttcttttccgttcacggtcactctgacataaacttgagccagcgcgtcttcgcctttccggttggattggatgcggtagtctgtcagttcaatatttttatcgatgcagcgcccgagcgtattataaacggcttctacgctgcccgcccccgttgccgcctcttgaatcagctgttcgttttcctgatttttcaaagagactgttgcagtcggcacctgagacgttccgtaatgcacttgcagagacagaaattcatagccgatttttttgtccgtcactttttcttctaaaataagagaaatcaagtcatcatcggtgatttcttttttcttttcggtcagttctttaaacatcgtaaaaaatttattgatttcctcactatcaaactggaatccaagcgcattcaggcggtctttgaacgcatggcgtccggaatgctttccgagtacgagcgcatcagcagtcacgccgacaagttccggtgaaatgatttcatatgttgatttttctttcaggaaaccgtcttggtgaatgccggattcatgtgcgaaagcgttatctccgacgattgctttgttgcggggaacggccatgcccgtcagtttgctgacaagatcactcgtccgcttcaattcatgaagattgagagatgaatcggcttgatgcgcgtcatttctgacatgaagcgcaacggcgatttcctctagcgcggcgttcccggctctttctcctatgccgttaatggcgcattcaatttgatcagcgccgttctcaattgccgaaagtgagttggcaaccgccattccgagatcatcgtggcaatgggcagagagctttacccggctgatattcggaacgtgttccttcatatatttaaagatgtttccgtattcagcaggcgtcaggtaacctacagtgtccggcaggttgatgacgctcgcgccggcatcaatcactttttctacgatttcagccagaaacggaagttcggtgcggcatgcgtcttctgccgaccattgaacgatcggaaagcgttcttttgcatacttcaccatttcaaccgctttttccttaacctcttcccgcgtcattttcagcttatgcttcagatgaatgtcagaggtggcgataaagatgtgaatgcgcgggctgaccccgtctttcagcgcttcccaggctgcgtcaatgtcacctttgacagatcgagcaagccctgttaccgaacaatttttaatcgttcttgcgatttcctgcacggctaaaaaatcacctcgggatgaagcgggaaatcccgcttcaataatgtccaccccgagtctttcaagctgcttggctatcgccagtttctcccgggaattgaggttgaccccgggagattgttcaccgtcacgaagggtcgtgtcgaaaacattaattttgcgcaacggagaccaccgcttccttctttttgccttgtttgacaaacggcatcatttcacgaagctgtctgccgaccttttcaatctgatgctcgttttcgcttgcattgatcgcattgaaacgaggacggttcacttggttttccacgatccattcttttgcgaatgtaccgttttgaatatccgttaatacttgtttcatcgattcttttaccttcgcatcgactacgcgcggtcctgatacaaagtctccccattgagccgtatcggaaatagagtatctcatgcccgccaatccttcttcatacatcaagtctacgatcagcttcagttcgtgcagacactcgaagtatgcgagttcaggctggtagccggcttctgtcagcgtttcaaaacccgctttgacaagcgccgttaaacctccgcacagaacagcctgctcaccgaacaaatccgtttccgtttcttccttaaatgttgtttcaagaacccccgcacgcgctccgccgattccttttgcataagcaagagccgtatctttcgcttcgcctgatacatcctggtagatggcaaacaatgccggtacgcccgcgccttgttcatatgttcttctgacaaggtgtccaggtcctttaggggcgacaaggaatacatccacatcagcaggaggcacgatctgatggaaatggacgttaaatccgtgtgcgaataccaatgacttgcccgccgtcaattcatctttgatttcagcttcatatactttttgctgctgctcatccggaagaagaaccataatgatatcagcctgggcagccgcttctcttaccgaaaagactttatgaccgtcttcttgggcctgtgtaaatgatttgccttgtctgacgccgacaatgacatcaattccgctttcttttaagttcagcgcgtgtgcatgaccttgtgaaccgtaaccgataatcgctacttttttacctgccaatacgttctctttgatatcaccgttataatatacttttaccattttaatctctcccttttttgtgttatacaattgaaattgttttattggatgacgccttctgctgggttcccctcgcaaaagccgttgtgcccgttctcgcgatttctttaattccgtaaggtttgagaagctctatgagcgcttcgattttattagattcgccggtaacctgaacgacgatgctgtctcttgagacatcaacgacggaagctctgaacggctcaatgattccattgatttccgttctggccgacggtgcggaaacaactttgattaatgccagctcacgctgtacaatcgattggtttgtaatatccgtcactttcaggacgtcaatttgtttgttaagctgctttgtcagctgctctacgtcattttcgccttccacatggacgacaaatgtaatccttgaaacaccgcttgtttccgtgtggcctacagtgatgctttcgatattatagtgtctttttgtaaacaggccggtgatccggtttaatacccccgagcggttgaccaccgttaatgtgataatgcgtttcaaggtttcacccccaccatttcatgaagtcctttacccggcgcgatcatcgggaatactttctcgcttttggcgacccggacgtcaataacggccggttcttttgatgaaagcgcctttttaagctcttcttccgcctcttcttccgatgaaatccgaacgcctttaatgccgtaggcttctgacaatttgacaaagtcaggctgcgccgagaatttggattcagaatagcgttcttcatagaagatttcctgccactgtctgaccatgcccagacattcgttgttcaagataaccactttgacaggaagattcagctgccggatgacatctaattcctgaagggtcatctgaaaaccgccgtctccgaggatggcaacgaccgtggcgttacgatcggccagctgcgctccgatggccgccggaaggccgaagcccattgtgccgagccccccgaggtcacccacttatcagcctttcggaaaggataaaactgagccgcccacatctggtgctggccgacatccgtcgccacaatcgcctcaccgtttgtgaattggtgaatatactcaatcagcttttggggtttcaagccctcttctctgtcgtctgtataccaaagcggatattcttctttccattctgaaagctgctgtttccattcctctgtctgtccctgttttccgttttgcttcaataattcctgaaggacgattttactgtcgccgaccaccggaatctgcgtttcgataatttttccgatttcagcaggatcaatatcgatatgcgctactttggccgattttgcaaaatgcttcagatttccggtcacgcgatcatcgaaccgcgctccgatgctgatcagcaagtcacagtggtaaagcgccatattcgctgtgtatgtgccgtgcatccccgccattcccagaaaaagaggatggtctgccgggaaaccgcccagaccgagaagcgtgtgcgctaccggaatttgctgctgttcggcataattttttaaatcttctgaagctttaccgtgcaaaacacccgctccggctaaaataaccggctttttcgcactgctgacagcttccacgagctttcggatctgcagatagttaggctcttttaccggctgataacccggaagattgatctcgtgatcatatctgaattctccttcaaatgctgcgacatccttcggtatatcaattaataccgggcccggtcttcccgtcgtggcaatatggaacgcctctttaatcacacgggggagatcttccggacggcggacttggtagctgtgtttcgtaatcggcatcgtaattcctaaaatgtcggcttcctggaaagcgtcgctgccgatgaccgaagtggcgacctgaccggtaaacactacgagcggcagtgaatcaatcatcgcatccgcaagaccggtaactaaatttgtcgctccgggtccggaggtagcaatcacaacccccggctttccggagactctcgcatacccttctgccgcatgaatcgcgccttgctcgtggcggggcaggatgtgaaccaatcctgattgatacagtttatcgtaaatcggaaggacggctccccccggatagccgaagatcatctcgacattttctttctttaatgattcaatcagcatcagagccccgttcattgtttttgtacaatcggcagacaaagaatccgcctgtacatttgtgcccattttcagttcctccttttcaatgttcccttctaaaatccaattcataaaacgcagcgccggctgacgcaaataaaaaagccttcccacccacattcagccaagcatttcatgcgatagccaaaaggggcgaaaaggctttgctctccgcggtaccacccttgtttacggtcatatgcagaccgtctcatggataatgattatccgttttgataacgagtaaacattgcgttcactcggccgagtcctactctttacatttcagaccggcactctgaggggagttcactttgatttgttttaccggctctcagcgttaccggctctctgtgaaaaacttcagcaaagctacttatcctcttctgcgctttttattatggcagctcttttattaaaaaagaaccttcatttgtttgttttttcagtgttttatgatttttctttttagtgtgaatcatttatttatttttgtttgaactcatattacgcccgtttgcagacagtgtcaacagcatttttataattattagacaatttagattaatcaatctattttgtatacgctttcattactgatataaaaggatcggcaaatgttaaaagtttttatattttttttattaatctctcaagattacatgaaatttttccgttcatatacgaatatgtcacattttattacgcgatttttctctgtccttccggcatgcttgtcagatattccgttcgattgaacaggctctttatacagacatacgcatacactgttcttatctcgtaagaaatgagtgatgtcatgaataagatgttatcaggcatgcagggcctgcctcctggatttccgcctttaccggtcttaccgccgcagtcttactatcctccggccccgatgcatacagcaccatatcaaggcggcccttcttttcagcagggatttccgccatccggatacggacagcagaccccgcaaagcacactgtcattcgccggacagcaattcgttccgtacccttatacatccgggtactacggccaaaccttcagtgacgtcggcggaagcctcggcgccggggcacatcccggcgcgctcggtggcggtttcagcggccatgccgggggcttcagcgctccgagcggattcagatgatacaaaaaccggtctcacacggccggtttcttttcttattcacagagtataacgttcattccactgattcatttcctgctccgtatagtaatcagcccttgaaacctcaacaatgattaaaccgcattgagtgattaaaaattgtttcagttcctcaaacagctcgtcttttccgcaaaagatcgtttctatattgtgatttttatatgcaaatgcgtacttcaaaagctaattcctcctgctgtctttctatcaatcatcaacaaaacgtatgatagaaatcagataatttatcactcaagggcgccttaagtatctttatacatatatttattacggtaaatattacattaagtttcatttacattaaaattactttacaattttcatcaaatacggaacttttgtttcgtaaaactaaaaataaaatacaaaaaaacctcaaacccattgtcagggcttgaggttttttatacgtcccaggagagattcgaactcccgaccgacggcttagaaggccgttgctctatccggctgagctactgggacatgaaaaacaaatatctgctgattattttaccatgatatcagtgaattgacaatatagtcatccgataaaaaaggccagcggcatcagttttcactctgatgtcaccagctctttttttgtacgtcccaggagagattcgaactcccgaccgacggcttagaaggccgttgctctatccagctgagctactgggacagcttttgctttatgtatcagcgacaagatttattatatacaggttcaaatcataagtcaatattttttaaaaaacttttgatggggaagaatgaaatctcccccatcacttgttaaaaactgattgtattccccaagtccttcaattcccgacccgtttcgtcgtaaaatgtcacggcgccttctctttctgtaagagtaagaatggcatagcttttcacattgcggactctcggaagacggatgctgcccggattaatcaaaagcttgccccgaagcacttcactccccgcaatatgtgaatggccgaagcagacgatatccgccccaagctcttccgcccggtaaaaaacagttaaaagtgactgtttaatgccgtgaagatgcccgtgaacggccagaattttctttgaaccggcatccagaaggagttcatcctgaaacccgccgccaaagtcgcaattgcctttcaccttgtgatacggcgtgagtgccggatgtgcggcgtcaagctctgaatcaccgcaatgaatcatcagatccgcttcgtcttcgtgccgctttgcaatcgtctccagctcgtcttcaaggccgtgactgtcacttattatcagcactttcattgcatacgctcccccttatgaatcaagcagctttgacagtttcttgagcgcctcagccctgtggctgattttgtttttctcagcgcttgtcagctgggccatggttttatctttatcttttacaataaaaatgggatcatagccgaacccgttatctccttcgggtccttctgcaatatacccttcaacatgaccttcgaccgtttttgtttcctgccccggcatgctgacggcaagggcgcagcggaaacgggccgtgcgctgctctttttcgatgccttttaattctgacagcaccttgtccatattcgccttatcatcttttgcttctccggcataacgggctgaataaacgcccggtctgcctccaaggttgtccactgataaaccggagtcgtctgcaatgaccattttgttgacggcttttgccacggcttccgcttttaagatggcgttttcttcaaaggtatgtccggtttcctcaatttcttccgtaaatccgatttccgccaaagaagagacgctgtagcctttcggttcgagtatttccttgaattctttcacttttccctgattgtgtgtcgcaataatgacttctttcacgctgatcaggcctctctttcttatttcagttcaggcaatgtttctcccagcacttctttttgcttttgaataagcgtctggattcctttttcggcaaggcttaacagtccgtttaaatcttcacgggagaatgtggcttcttcgcccgtcccttgaagctctacaaaacgtccgcttcccgtcatgatgatattcatgtcgacttcagccgccgaatcctcttcataattcagatccaaaagaaggccttcttctttatccatcccaacagaaatggccgcgagataatctgtcacgggagaggttttgataacgccgctttttacgagtttgccggtcgcaatggccattgccaagaatgcgccggtaatggaagccgttcttgttccgccgtcagcttgaatgacgtcacagtcgatccagatcgtccgttcgccgagcttctccaaatcaacgacggcccggagcgcgcgcccgatcagccgctgaatttccatcgttctgccggagacctttccttttgaagattctcttatcgttctttgattcgtcgcgcggggaagcatgctgtattccgctgtgatccagccttttcctccgccgcgtaaaaatggcggcacccggtcttccacagatgcattacagatgacctttgtatttcccgctgtaattaaaacagagccttccgggtgagtgataaaatccaaatcaaatgtgatagggcgcagctcatcgtgctgtcttccgtcgtgtctcatattttacctccgattatatgtacataaaccttttgttccggattgtgaataaagaaagaggcagccggaacgctaacctcttttttactagtatatcaaaaatcgcaaattaaaaactacccgtattcacttgtgccggcctcgaaacaggttttgaaagggattctcctttttcattcaccagttctgattttccgtttacttttatagaaacacttttaatcgacggctgttcggttaacgtgagaacgatgctgtccagtacgcccgatgacaccatttttgttttttcgtcggcgcttccgtaaatagagctgttaaagtccagtgtaacctggccgtctttcactttcggcttgctgagaagcttaacatcgttattaaagtccgtcaaaagcccgcttgctttgcccggtccgtcggtgagctgttcaacggcagcggtgatgtcatttgtttccgaattgtcaatccgctttgtaacaggcacgtagtattcgcttgtctctgtttccgccagataatatacagtcagcggatgggtgtctgtcagatcattcactccggccgtttcaatattaatcccgtcttttctgcttaagtcgcccgtaatcggcgtgccgcccacaggcatttctttcagttcgtgcccgttgattctgattttgactttatctattgagctgaattgggtaagcgtccacgtaatcgattgcaggattttttgttcgtcttcttttttatagtttttaaattccttcgaaaaatcagcgactgcagtgccgtcttttttaatatcgacatttaccgtcgtatccgcagggagcaccgctctgaagccgttcggcaggatttctgatacaggccctccctgaaccaagtactcaagggcctgctttgcggttccctcactgttcggaagaggcagtgtctgtgctgcgacatagccgtttttatcaatcagatacagttctcgcatgactgtattggccggctggtcggctttagaagtgccgtttttctctgactgctttggttttgcctgaattcccgcttcatcctttacatatgaaatgtcttgaggcgggtcaatttccccggctgttttatcggattgaaacaaaccgcatccagataacacaaaagccgaagtaagacatgttgcagcaatgactgcaggtccttttttcagcatacttttccctcctaaggctgtttgtactatgatgtatacgagccctgtccgggaaatagaccgggaagcgcaaaaaaacccgctgtaaacagcggggtttttttgatttattttctgaccggctcttgaagggagatgcactcgacatggccgatttcgtggccgaaccagtcttcggcaatttttgcgaagccgttccgctctcccgttgtaagaaattgatgctccggtgcatgtttcgattggtttaacaaacctttataagacaagatggtgctcacttctctcgccgtctcgtctccggaggaaatgattttcacatgctctcccatataattctgaatcgggtcttttaagatcggataatgcgtacatcctaaaatcaaggtgtcaattgatgtaccttttaaaggttcaagcgatgcttcaaccgcttcctccgctgattcctgaagaaaccgtccgctttccacaaacggcacgagcagcggacaagccgtgttctcaacttgaagttctgcgtttaacccgagcagcgcctgctcatacgctctgcttttaatggtattgaccgtgccgatgacgccgatatgctggtttttcgtgacctttatcgccgttctcgcacccggctgaatgacgccgacaaccggaatatccgttttgcgctgaatatcctccaaggcaatggccgtggccgtattacaggcgatcacgagcattttgatatggtggttttccagcaggtaatcggtcatttcccacgtgtattgaagaacttcttcttcaggacgcgggccgtacgggcagcgttttgtatctcccacatagatgatattttccttcggtagctgtctcatgatttccttagcaacggttaacccgccaaccccggaatcaatgactcctatcggctgttccaacaaaatcgcctcattttcttttcatttcatgctgcagtttcaataatgatttttcgaaagcggctgtttcttcttcggaaaatgtcgcaaacatatcccgcaaataagcctgtcttttcaaaatcacttcttggataatgcgctctccttcagcgagaagatgaattctgacgacccgtctgtcagccgggtctttgacccgctcgacaagcttatttttttccatgcggtctatcagatccgtcgtcgtgctgcaagccaaatacattttgcctgataattcgcctattgtcatatcccccaattcataaagccattgaagccccacgaattgcggcggtgtaattgcatattggttaaggatttctcttcctttttgtttaatgatcgcagcgatatggcggagtgatttttcgatatccgcaacatgctctacagattttgatgtcatttgtccatccctcactcaaggatctttctgggctatgcgctccgtgtctattttccttctttttttaagaaaatgcaagactgacggagaaaaaggaaaaaccgggattttcaccgcatgcccatcagcccgggcgccaacgcaaataaccggctccttctcgtaaagaaggaaaaccggcaagaatcagagctctagctcacccattctaagaagctcgacaacagcttgcgaacgccctttcacacctaacttctgcatggcatttgaaatgtgattccgtacagttttttcactgataaatagctcgcttgcaatttcctttgttgtcttgtcttgaacgagcaattcgaatacttctctttctcttttggtcagcagcggctttgattgaaaatctttctccttcaagtattgtaaccctccttgctaaggtgagagcgaatctgaaacgaatgggtttatatagtcaagatatcatatgtaaagggcgcttcggaggtgacgtctcttagagaaatagttatccgttcaggcgagcagaatgcctttctcccgctccgtccagctgaccgctttgccgctttttttcgacacttgaaccataacgacggaacctgtaaagcacggcaggcccgactcattttctccaaggtaatgaagggtgacggacgcatttccggcagcgcttgctttcacataaatccgcagattttcatacggcatcacctgacgcatatagtcgcactgctggcttgcgacgaccgtcatcgtttccgagttttgcgccgtcatgccccgctgtttaaaataagcgatccgtgcttcttcaaaatagatgaaaggggttacattattcatatggccgaacatatccgtttctgaaaaacgaaccgatacttcagtaaagaaagaaaacgactgtctccattcttcaaacgggatatcaatatattgcggttgtttcatcaccttcagctccttataaaaaaacctctcccgtgcggaagaggctctttttctctttcttatactctgtcgcttccgaagaaattacggaatgcttgtaaattggtatctctgttcaaagcagcgattgaagtcgtaagcggaatgcctttcgggcaggattgaacacagttttgtgaattcccgcaatctccgaggccgccgtctgtcattaaagcttctaaacgttctgctttgttcatcgcgcccgtcggatgggcattaaacagacgcacttgtgacatcggggcaggccccatgaatttcgacttgctgttgacgttcgggcaggcttcaaggcagacgccgcatgtcatgcatttagacaattcatatgcccactggcggcgtttttccggcattctcggccccggccccaaatcgtaagttccgtcaatcggcacccatgctttcacttttttcagtgaatcaaacattctgctgcggtcaacctgaaggtcacggacaaccgggaatgttttcatcggcttcagacggatcggctgttccagcttatcaatcagcgccgtacacgactggcgcggtcttccgttgatgaccatggagcaggcgccgcatacttcttcaagacagttcatgtcccatgcgaccggagtggttttctctccttttgcattcacgggatttctgcggatttccatcagggcggaaatcacgttcagattcgggcggtaattgatttcgaattcttcatcgtatggcgcgctttcgggcgtatcctggcgtgtaatgataaaccgtatctttttctcactcatgattatttcgccaccttcttcttcgagtagtcgcgtttacggggcgcaatcagtgatacatcgacatcctgatattcaaattccggagcttcaaacggaccggcatgtttagccatcgtcgttttgagccactcatcgtcatttctttcagggaaatccggtttatagtgcgctccccggctttcatttcggttatatgcgccgagcgtgatgactctggcaagctgaagcatattggagaactggcgggtgaacatcgccccttggttgctccattttgtcgtatcgttgatattgattttcttaaagcgttccatcagctcttggattttgtcatccgttttcaaaagcttgtcgttgtggcggaccaccgtgacgttggccgtcatccattctccgagctcacggtgaagcacgtaggcattttcatcgccgtccatcttcatgatatcggcccatttttcttcttcttttttcacataggaatcaaataatgaagaagacaggtcttccgctgatgtttcaagtccggaaacatatttcaccgcattcggtccggccaccattcctccgtagatggcggaaagcagagagttcgcccctaaacggtttcctccgtgcattgaataatcacattcacccgctgcgaacagtccgcggatgcttgtcatctgatcataatcaacccacagtccgcccatcgaatagtgaacggcagggaaaattttcatcggaagcttgcgcgggtcatcgcccatgaatttttcatagatttcgataatgccgccaagcttaacgtcaagctctttcggatctttgtgcgacagatcgagatacaccatgttttctccgttgatgccgagtttctgattcacgcacacgtcaaagatttcacgtgtcgcaatatcccgcggcacgaggtttccgtaagccggatatttttcctcgaggaagtaccaaggttttccgtctttgtacgtccagactctaccgccctcgccgcgcgccgattcactcatcagacgcagtttatcgtcccccgggattgctgtcgggtgaatttggataaattcgccgtttgcataataagcgccctgctgatagacgattgatgcggcagatcccgtattgatcatgctgtttgttgattttccgaatacgattccgggtcctcccgtcgccataataacggcgtcagaacggaatgactcgatttgcatattggtcagattttgggctacgataccgcggcacgtgcgctcatcgtcaagaacggcgccgaggaattcccagccttcgtattttgtgacgagacccgccacttcatatctgcgcacctgctcgtccagtgcgtaaagaagctgctgacccgtcgtcgctcccgcgtaagcggttctgtgatgctgtgtacccccgaaacggcggaagtccaagagcccttccggcgttctgttaaacataacccccatgcggtccaataagtggataatggacggcgccgcttcacacatcgcttttacaggaggctggtttgccaaaaagtcgcctccgtataccgtgtcatcaaaatgctcaaacggagagtctccttccccttttgtgttgacagctccgtttatcccgccctgcgcgcagaccgagtgagagcgtttgaccggaacgatggaaaacaatttaacggccgtgcctgattccgctgctttaattgtcgccatgaggccggctagacccccgccgactacgataatgcttgattgactcatgatagcccctctccctctagtaatctagttctcttacacaaacgcaaaaatcgcttttaaacctacgtatgaaagcgctaaaaatataatcagcgtcacgtaagtcgaaattctttgagaacgcggcgtaaccgtgatcccccatgtgaccgcaaaagaccataagccgtttgaaaagtggaaaatgaccgataaaacgcctacaatgtaaaaaccgagcataaacggcgagctcagaatattcgccatcatatcgaagttgacttcagcgcccatctgcgcggcaatccgcgtctgccacacatgccagctgacgaaaataagggtgagaataccagtgacacgctgaagcacaaacatccagtttctgaaataactgtagtggccagcgttgtttttcgcagtaaatgctatgtacacaccgtaaaccgcatgataaattaaaggtaagaaaataataaaaatttctaacgcatacctgaacggcagactgtccataaagccggccgccttgttaaacgcatccgctccccttgcggcaaattggttgacgactaaatgctggatcaaaaagatgccgaccggaataacaccgagcaaggaatgcaatcttcgaaaataaaactctctgttcccagacattactttaccccctgtttgatttaagtgcgaaatgtactaaaatctctgcccccacttcgtttcaattgtaagcactttattaaaatttattgacaatttcattttactcctccctcaaaagggcgtcaagaaaacgtgtacataaattataattttcggaattgattatctggagggaaaattttattttcctgcgatatctttctcacattttttcgcgtgttttataggatcatcctgtaatcctcccccctgtttaagctataataaacgaaggagagaggggaatacataatatgaagaataattatgaagcagctttagaacctttaactgaactcgacgtcagcgcatacggctacgaattaatccgggaaatcgtgcttccggatatcctcggtccggatcattcatcgatgatgtattgggcgggaaaacgcctcgcccgcaaatttcctcttcaatcgtgggaagaaatccccgccttttttgaaaaagccggctggggaactttgacaaacgcaggatcgaaaaaacaagaactggaatttgaactggaaggaccgctcgtatccagcaggctcaaacatcagaaagagccttgtttccagcttgaagccggttttatagccgaacagattcaattgatgaacgatcagattgcagaatcttatgaacaggtaaaaaagagagcggataaagtcgtcctgactgtaaaatgggatatgaaggaccctgtataattgaaaaaggcggtgactcaaaagtcccgcctttttgcctgcccgtttatacggcagacggctgtttagacagctcaaacgcatcatgaagcgcttcgaccgctttcaccatatcattttcgctgacaaccgctgatacttttatttcggatgtgcttaccattttgacttgtacatttttttccgccagtacggcaaacatgtccgcggcgacgccgggatttgaaaccatgcccgacccgacaatggagactttcgccagttttctttcggtttcaattttttcatagttaagcgcgtttttatattcttcaagcacggcgaccgtttgggcggcatcttccgttttcactgagaaagaaatatccgcttccccatcatccgactgtgtctgaataatgatgtcaacgttgatgtttcgttttgccagcgcggtgaagattgttgaaagtgttgtcagtccgcttgcaaggcccgtgacggacacccttgtgatctggtcttcaaatgcaattcctctgacgattaaattctgctccattgatgattcctcctcaattaatgttccggcttcatgttccgtgcttgaccgcacttctaaaggcacttggtagtttttcgcgaactcaaccgcccgcgggtgaagaacacccgctccgagatttgcaagttccagcatttcatcataagaaatccccgccagttttctcgctgaccggacataccgcggatctgtcgtaaatacgcccggaacatctgtataaatgtcgcatttatccgcttccagcgctgctgcaagagcgaccgccgtggtatcagaaccgccccgtccgagcgtcgtgatgccgccgtcttccgttacgccctgaaaaccggcaacgactgtaattttgccttctgcaagctgcgaacgaatcgccgtgatatcaatatccgtaattctcgcattgccgtgaacggcttccgtgcggacacccgcctgccagcccgtataagagacggcgtcatatcctttttcctgaagcgccatggccaaaagcgaaatcgtgacctgctcccccgtagacaaaagcatatccatctcgcgtctgcttggttcagatgtgatttcagccgcgaggttaacgagcgcgtcggttgattttcccattgccgaaacgacgactacgacatcatggcctttttgcttttcagcaatggcgcgatttgcggcattttgaattttttcggcagagccgacggaagtgcctccgaatttttgtacgataagacccatactagaccaccctttacattttggttcgtgcgggtgaggagaaaagagcgttttgtccacaataaaaaaagcaatgagaggaatagctctcattgcttttcatatcagtacgattgattatgaacaacgagatagccctccaagaaaatgaattcttgacagccttacatttatttaatgcaaggccagcaaatcacaccgatgggatgtgacacacttcggcgacgctcccctttcagcctttttcgcagaatccatcattctccaaaggcttactattgaagttcgcacctctatcttcaccatataacacgatcttatgaaattagttcacattctagcagatttttcagaaaagcacaatactatttttttaatttttcaaacagcaactgggccgccgcggccggcacaccggcttttttgatatcgtcaaggcttgcttccttcatctttttgacagatccgaaatgttttaagagcatttttttgcgtttttcgccgattccggggatatcatccagaacggattgaaagacgctttttccccggatctgtctgtgaaagctgatcgcaaaacggtgaacttcgtcctgaatgcgctgaagcaggtaaaactcttggctgttccgctccagaaacaccggttcaagcgggtcgccgatcaaaaggttcgatgtccggtgtttatcatctttcgccagtcccgctaccgggacatcaaggccgagctcattctcgagcacgtcgcgcgccgcgttaatctgcccttttccgccgtcaatgatgattaaatccggcagcggaagattttcgcggagcaccctcgtgtatcttcttctgacgacttccctcattgagccgtaatcgtccggccctgttacggttttaattttatatttgcgatattcctttttattcggttttccgtcaataaagacaatcatggccgatacggggtttgtgccttgaatattggagttgtcaaacgcttcaatccgatgcggcgtgtaaatattcagtgcttcgccgagccgttcggctgcaccgattgaccgttcctcatcccgctcgattaacgagaatttttcccgcagggcgattttcgcatttttgtgcgcaagcaaaagcagctcttttttcggaccttttttcggctgatgcacggcggtttccaacagctcgccaatcatgtccctgtcaacgctgtcaggcaccagaatttccttaggcagaaagtgattgtttttggaatagaactggccgatgaaggtcagaaactcttcatccgcttcctgatacatcggaaacatgctgacatcgcgttcgatcagttttccttggcgtataaaaaagacttgaacgcacatccagcctttatcgtaggcatatgcaaacacatcgcggtccagaaggtcattcatggtcattttctgcttctccatcgtcgattcgatgtgagcaagctggtcgcggaattctttagcccgttcaaattcaagcttttcggccgcttctgccattttcgcttcaagctcttttttgatttcgttatgccctccctttaaaaaacgggtgatgtcttcaacaatctcgcggtttgtctcctcagatatatcctttacacatggggcgaggcattggccgagatgataataaagacagacgcggtccggaagctttgagcatttcctgagcgggtaaaggcggtccagcagttttttcgtttcccgcgccgcctgcacattcggatacgggccgaaatagcgtcccttgtcttttttgacattccgggtgacaatcagccgaggatgacgttcatgggtgattttaataaagggataggttttatcatctttcagcatgacattgtatttcggatcgtattttttaatcagattcatttccaaaataagcgcttcaagattggaggaagtcacgatatattcaaagtcctcaatctccgtcaccagccgttgggttttcgcgtcgtgagaaccggtgaaataagaccgcaccctgtttttcaagactttcgctttccccacgtagatgactgttttctgacggtctttcattaaataacagcccggctgatcgggaaggagggccagcttttctttcagttgtttatccatacgttacccttccttacattcatttctcgtgtccattcagtgtatcacgaacatttgtttttctccattctcagcttttggaagatcaaaaaaaggcgacccctttcaaaggaatcgccctgccgtaacggaagctttcggcttacagatgtttgtttacaagctcttcaagagcttctttcggtttgaagccgacagatgtttcaacgacttctccgtcttttagcacgagaagtgtcgggatgctcatgacgccgtatttaccggcagtttcttggttttcatccacgtcgattttgacgattttcagtttgtctcccatttcttgatcaagctcttcaagaacgggcgcgatcattttacaaggtccgcaccaaggagcccagaaatcagccaatacgacaccttcacttgtttcagctgagaacgattgatcagttgcttttacgatagccatttgttattcctccaattgtcaaatgatgatttttagtatagcatctcccattcgttcatgctaatttaatgcttatattattttcccccgaacccgccggaaataatcttatttatacagtgtattataaccgggcggcgggcgttcaaaacttaagatggacctgcaggcagcgtgattaatacaatcgccatcggaggaagctccgcctcaagttttcctcccttttgagcaaacccggaaaacggcttcggtttgacgttttccggactgctgaatgtattgtgggcattcattttttccgcgtgcagaatcgttcccgaaggcgtccctgtctttttcatgccccgcagttcaatcttcacgtcagctttgtgcagatgatcgatattgcaaatgctgatatgtatgtctccgttctgctgtttggacgctgaaatgctgacttgcgggagccggccgtcattccattcgtacccggctgcatttgtttctgccgccaaaagagatgcgtcctggtgcaccttaaacatatcgaacacatgatacgtcggcgtcaacagcatttctttcccttctgtcaggatcattgcctgaagcacgttgacggtttgcgcgatattggccatctgtacgcggtctgcgtgctgatgaaaaatgtgaaaatgcgcggcggcgacaagggcgtcgcggatcgtattctgctgatacagaaagcccggatttgtgcccggctcaggatcaagccacgtgccccattcatcaatgatcagcccgactcttttttcgggatcgtactgatccatgatggcgctgtgccttgtgatcaattcatccatatgcgccgcttttttcatcgtgatgaaccattcatcttccgtaaactccgtcgctgatcctttccccttccagaagtcgcccggtattgtgtaataatgcaggctcagtccgtctatgagatccgcggcttttttcattaaagtttcagtccagcggtaatcgtcgacattcgcgccgccggcaattttatagatttcattaccgctgtaattacggacataggtttggaagtttctgtaaaggccagcataatactcaggatgcatgtttccgccgcagccccagttctcatttcctattccgaaatatttcagcttccacggtttttcccgcccgttttcttttctccagtcggacatcggcgtgcccgcttcaaacgtcatgtattcaatccaatcagccatttctttaaccgttccgctgccgacgttaccggcgatgtacggttcgcatccgagcagttcacaaagcatcataaactcgtgcgtgccgaattcattagaatcaatcgtcccgccccaatgggtattcagcattgttttgcgtttccctacgccgtttgcccaatggtattcatcagcaaaacagccgcccggccatctgaggacgggaatctgaagctgcttgagggcggcggcgacatccgtcctgacccctccggtattcggaatatcggaatcttttccgacccagatgccctcatatatgcctcttcccaggtgttccgcgaaatgtccgtatatgtttttattaatggttccccgtgtgatatcagtttgaatgactgccgtattgtgagacaaacttgatcattccttccccttaataagaatgaaagcactacagccgatctatctgggatgtatgctgtatggataagtttgtaagcgctttacaaaagcttattacattggttcgtacatgtcaatctgttgttttattaatctataatttgtacgaactaattaacacaaaccaaaaccctctgacaaataagccagagggttttgattatgaatgaatattggcatttttaaattcctgagtcagaagcggaaccacttcgaacaaatcgccgacaattccgtagtccgctattttaaatatttccgcttccgggtctttgttaatggcaacgatgaccttactgtttgacatgcccgccaaatgctgaatcgctccggaaattccgcaggcgatatacaaatccggcgtgacgacttttcccgtctggccgatttgaagagaatagtcgcagtagtccgcgtcacatgcgccgcgcgaagcgcccaccgctgctccgagcacctcggcaagttcttttaacggttcaaatccatctttgctttttacaccgcggccgcctgctacgataattttcgcttctgataaatccacgccgtccgccgtttttttgactacttcttcaatgaccgtccgcaaatctgccggaggcgccgcaagctcttcaatatcacccgtccggttcgcgtctttttctaatgcctgaatattattcggacgaattgtcgccagaatgaaaggatcggttgaaatcacctgttcaaaggctttgccggaatagatcggtcttgtaaaaacgatgttatctccggtaacgcttacatctgtgctgtctgaaatcagccccgtttcaaaccgggccgcaagcttaggtgacaaatcttttcccatagaagtgtggccgaaaatgaccgcatcaggcttttcattttcgatcaaatccccgagaattgcggcatatccgtccgccgtatactgagaaagccccggcgaatcggccgtaaatactttgtcggcgccgtactgaatgagttctgatgctgcatcagccgcgccctttcccatcagcacgccgatgacatctcctccgccggaaatggttttgcctgcggctatggcttcaaaggtgacgttccgtaaggcgccgtcacgaatttctccgagtacgatcactttttttcccattctgacatcccccagtttctttaatatcagtttatacgactttggcttcttttctcagcagtgatacaagctccttcgcctgctcagaggcttctccttcgatcagtctgcccgcttctttttgcggcggcagaaaacgttcgatcgttttgagcttcggtgcggcatcatcttcatcaatgccgagatcatcgagctcaagttcttccagcggttttttcttcgccttcataatgcccggaagcgacggatagcgcggctcgtttaagccttgctgtgccgtgatgactaaaggaagtgaggttttaatgatttcggtatccccttcgttgtctttctctgccgcagcttcatcgccgctgattgtcagttttgtaatcgttgtgacgcaaggaatgttcagcagttcggcaagccttggagccacttggccggaaccgccgtcaatcgcgacatttccgccgagaatcagatcatattcccggtccttgaaataatgatataagatagttgaaacggagtattggtcaggatcgctcagatcatcttcaatattgattaacaccgcctggtcacagcccatcgcaagggcggttctcagttctttctccgcatcttctccgccgacggttacggcggtcacggttccgccgtgctcttccttcagctgaatggcttcttcaatggcgtattcatcatacggattaatgataaattcggccccgtcctcctgaatctttcctgcttcaatgacgattttctcttctgtgtcaaacgtccgtttcatcagtacaaatagattcatattcttatcccctttatcttcgcccaccgaattgaggctttcttttttcgagaaatgcctgaatgccttcttttgcgtcatctgatgcaaatgcttccccaaagcgctttgcttcaagctttaagccgccgtcataagaatagaccttgtttgaataaaggagctcaagcagaaaagccatcgactgcgggcttttttccgcaaacttgcccgcgagcgttttcgctttttgcagcagctcttcctcatgttcggcgcctatcgtgacaagaccgaggctgagcgcttcttctccggttacaggttctgaagtgccgatcatttcaagcgctttcgccgtaccgacgtaccggggaagccgctgcgtcccggcaaagcccggaataatgccgagattcagctcgggcaggccgagctttgcatctaatgtagcgattctgatatggcaggccatggcaagctcaaggccgccgccgagcgcagcgccgtgaatcgctgcgataacgggcttcggaaacccttcaattctttccatcagctgctggcctttatccgccatggcagaagattgctcaagattttcaagcgacgtaaattcctttatatcagcgcccgccgagaaaaatttcccctctccgcgaatgatgatgcttctgacactgtcatctgtttcacagcggtcgaacagaccggacaactcatctaaaaccgcgccggacagcgcgtttgccggctgatgattaatggtgatcaccgcaacagattgttctaccgccatcgaaaggctgttcatccgtcaaccccctttagttttgatgaatccctgacaccaacagctccaataccttgtctgacaaatccggaagatcatatttctgatcgttcatcacccatgttgtcactgtttcatctatcgtcccgaatatcatctgccgggcgaggcggacgtcgagattatctttccattcgcccgactcgattccttcggtcaaaatggtgtccagcatgtttaaataaccttttaaaatatcattgattttcagacgcagcttgatattcgactgtctgagctcaagctgggtcacaatcgcgaggtggcggtcattgccgagcagtgtgaaatgctgcttaataacgagagcgagtttttcttttgccgtcgttttttctttcacttcttcttccatgcgttcaatgaactggcccatcttttctttaaaaagagaaatgagtatatcctctttgtttttgaaatataaatagatggtgccgtccgcaacgccggcctgcttggcgattttggacacctgtgattggtgatagccgttttccgctatgacttctactgctgcatcaataatctgcatatactttggccgtttttggttcaatgtcatcgttccttccttcgataaatgaatgactattcattcataacttcatgataaaaaggaatccggattttgtcaagtttttcttttaaggcaccttgttttcatgggaagcatcttcctcttcgactaaacgccttcttaatatttttccgacggccgttttcggaagctcttttctgaattcgtacagcttcgggactttgtacggcgcaagccgctctcttgcaaacgcatcaagctcatcggcatctgcctcggcgccttttttcaaaacgataaatgctttcaccgtttcccctctgtaggaatcagggacgcccgctaccacgatttcctgaacggcttcatgctcataaagcgcctcctccacctcgcgggggtaaatgttgtatccgccggcaatgatgatgtcttttttcctgtcggcgatgtagaaaaatccttcctcatccatatatcccatatctccggtaaacagccagccgtctctgatgacacgcgccgtctcctcctgcttattccaatagcctttcatgacctgagggccttttacgatcagctcgccgtgttcatacggctccgcaagcccgcctttttcttctgaatagattcccgcatcggtattgggccagggacagccgatgctgccgggtttattttttccccagatgaagtttgaatgggtaaccggtgatgcttcggataatccgtagccttccacaagctttcctccggtcactttttcaaatttctgtttgacctcaaccggcagtgccgctgaaccgctcggacagctttcaatggaggacagatcatacttattcagctccgggtgatgcagcagcccgatgtaaatcgtcggcgccccggggaaaaccgtcggcttcaacctgtcgattgttttcagtgtatccaaaggattgaatttaggaagaaggatcatttcacatccctgcataatggaaaaattgagcacggcggtcaatccgtacacatgaaaaaaaggcacgatgccgagcaccttttcggctccctttttcattttgtacatccaggcggcgcacatttctgtattggcctgaatgtttcggtgtgtgagcatgacgcctttcggatagccggttgttccgcccgtgtattgaagcacggcgatgtcatgcgcagggtcaatatcaaatggctctgcttcctctgctttttcgttttttaaaatatccgctaatttgtgaatttgttcgcagccgtcataatcaatatgcacctgttgcttttgcgtgagcgtataaagcatatttttcggaaacggcaaaaagtcttttatacttgttgtaataatgcgttcgacgagtgataacgttttcatttttatcactttcggaaacagcatatcgagggtgatgatcacgcgcggcgcactgtctttcagctgatactcaagctcgtgttccgtgtagagaggattggtctgaacgacaatgccgccggcaaacaatacgccgtaaaaagcgatgaccgactgcggacaattgggcagcataatggcggctctgtcaccttttttcaggcctgttttgcgtaaaaaagcggcaagctttaatgaatctgtgagaacgtcttggaatgtgagtttttttcctagaaaataaatggcggtatggttcgggaattgagctgcggagtttgtcagattggatggcagggtttgatcggtaaattcaagctcatgcggaatctcttcgggatattgagaaagccatggcttttcagactgcataatacctctcccttctgttttcctatacgctattattatagcagaagggtgattggaatgggaaagcgtttcatgggaaatttcgagtttcaggaggtgttgagttttctggaaacgctgcattttgaagggggagttcctatcctgcgccagctgccgaagccgattacgtcggccgcctttttgctccatccctttgtccggatgccagatggtcgggaagagcaaaagcgcaaacggccttatgaacatatgtatccgagtgatgaggagatcatcgcgatgggcagacccgtttcctggcaaaccgtcatgagcatttgcggcctgcgttctgaaaaagaaacggcgcttgcgcttatgactgctgtcacggcattgcgggaggaatatgcacatcctgaatccgccgagcggttaaatcggctccatcatcccgatctgtacttgccgagcgatgatgtcacttcgccatttttgattccgggacttttggatgtgttccgttcaaaaggcataaagcgctgcacttattatgagcctgtcgaagagaaaggcctattttcactcaatcaaacggcggcttcggatgtatgcggactgctgcgggctgacatgatcattgccgatgaaaaaacggcgcgccgcttttatgagcatatatgattcttttacgacactctttctcatggaagaacaagacattcagtctgtcgtccgcgccatgaattgggaagccgtcatttgctctgatacggcctgcataaactggtattctcaataaaaaaggccgccgatttgagttcggcagccttttttcagtattaagatgtcatgaccagataaataagtccgatgaacagaaaaatccccgctgccgacagcagcactttcgcaagcttctccatttttccccgtccccttaaatcccggcggccaccacaaatgacaggccgactgagatgacaaatgaaataaagccgacagctctgttatctttttcaatttctttatcaattttaaaccggggcgtcagaaattcaaagataaaatagctgattaaaagcataataaatccgtatacgccccagccgatcatttgcaaaagcgaattatgctgggcgatgctgtgctgaaagacatttgcgataccgagaattttccctccggtcgccattgccaccgcaagattgcctttttggatttccacccagtttttataggatgtcaccaattcaaacacggtcagaaaaatgacgagacacaagacggcaacactgtaataagccgcgatttcaacaagctcattttcccaaaaagcattcatgacgttttctccctttttattttagttcgacaatcgttacgcctgatcctccttctcccgcttccccgaaccgcgagcttttcacgctgcggtggtttttcagaagatcctgcaccccttttcggagggcgcccgtgccttttccgtgaatgatggacactctcggatagccggcgagcaccgcgtcatctaaatatttttcgacgcggctgagggcgttttcgtaacgctctcccctgaggtcaagttcaagggatacgtgataatccttcccttttacggcggtgattgctttttcttttttcggttcaggagccgatttgagaaactcaagatctttttccttcaccttcattttaaggatgccgatttggacgttccattctttctcgccggttttttcaagcagcgcccctttttgtccgaatgtgagcacctttacttcgtcgcccggcttcagctcgcgttttttctctgtttttctttccggctgctttgatttttcaaaagccggcatcgcgtctccgagacgttttttggcgtcaatcagctcgtgttccttaaaggatctgtgttcttgcttgatggacctgagctcgcggataatctgttcggcttcatttgcggcggcttccagtttttccgcagctttccgctcggcttcttccatcattttatctttttgggcattcagctcaatgatttgctgctgaagctctttgtgcagtttttctgcttcttttctgagtgattcggtttcagaaagttcttcatccgctctttttttgcttttttcaagcgatgcgatcatcagatcgacttcgttatgttcggcggtcatttctgacttcgcctggccgatgatatgctccggaagcccaaggcgtcttgagatttcaaatgcgttgcttcggcccggcactccgatcagaagtttataggtaggcgaaagcgtttcaatgtcaaattcaacgctggcattcatgacgccttgtctgttatatccgtatgctttcagttccggataatgggttgtcgcaagcactctggcgtttgtccggtgaacttcgtcaaggatgctcatggcaagcgccgccccttcctgcggatctgttccggcaccgagttcgtcaaacagcacaagactgttttcagacacgtcttttaaaatattgacgatattgaccatgtgagatgagaacgtactcagactttgttcgatcgactgttcatcgccgatatcggcaaacacattgtcaaatacggctgcttccgagccctcgtcagccggtatgtgcaatcctgcctgcgccattatcgtcagcagcccgagtgtttttaacgtaacggttttaccgcccgtattcggtcccgtgatgacgatcgttgaataatctccgcccagttcaatatcgttggccacgacttgatcttggggcagcagcggatggcgcgcttttttcagacggataaagccgtctccgttcatgaatggttttgtcgccttcattgcttttgcgtatctcgccttggcgaaaatgaaatccagtgtctgcagcacttccacattttgagcgatttcttgtgtgtgttcagccgtatgctccgtcagcatccggagaatccgttcgatttcctgtttttcttttactttcgcctgctgaagcgagttgttcatatctacgatcgcctgcggttcaataaacagtgtagcaccggatgaagatgtatcgtggacaattccgccgtagcttgatctgtattcctgtttgaccgggatgacaaagcggtcattccgaatcgtaacgatggtgtcagacagcattttagaagcggaagatgaacgcagcatcgattcaagccggtctctgactcttgattcaagcgtcctgagctgcgtgcggattccccttaaagcgggagacgcatgatcaagcacttcaccatggtcatcaatgcaggagttaatctccctttccaaatcgcctaatgtaatcagctcttctgcatgggcctgtatcagcggtatgccgacgccgtcttctgtcatttggctgataaaatgcttcatttgtttaacggcatacagcagcccggacaattcggtgaattccgccggcgtcagcacactgccgatttccgcccgccgtaaagcggatcttatgtcggtcaggccgccgaacggagcatggcctcgcaagcgcatgaccgcggatgcttcttcgacttcatccagctgtttttggatgtcggcgagatccgtcaaaggtttcagctgcagaagcttctccctgccgagcgatgaggcggcatgtgcggtaatctgttcttttactttatgaaattcaagtgatgataacactttttgctgcacggttttatggtcctccttacttaatcattgcgcgtcagaaatgctttgacctcatgtaacggccgggcgtttaacacatgttttgtctctgtccagcctttgcgcgcagcggtcacgcccgttttcatatcatcgagcatctcgatattatgggcatcggtattaatgaccaaagtcacacctttttcatttgctttgatcagatgctcagtccgtaaatcgaggcgcgcggggtttgcattcagttcaagcgccgtatttgttttggctgcgagctcaatcagcatgtcgatgtcgacttcatagccggcccgtctgccgatcaggcgtcccgtcgggtgggcgataatgtccacgtgcttattcgtcagcgcctgttcaagccgtttcataatgacatgctccggctggctgaagcttgaatgaatagatgcgatgacaagatccatttcagacagaacgctgtcatcataatcaagcgaaccgtcggggagaatgtccatttctacgcctttaaaaatatgaaaattttcaaattcagcgtttaacgcgtcaatttcttccgcctgttttctgagccgttcggccgttaacccgttggctacctttaaatattgggaatggtcggtgatcgccatgtactggtagccttttgccatacacgcttctgccatttctctgatggaaaaagcgccgtcactccaggctgagtgcatgtggagatcgccttttatcgctttatgctccacaaggtccgtttcttcccggtacgtgtcgacctcctgcccgctttctctgagctcaggaggaataaacggcagaccgaagtgggcgtaaaacgcttcttcgctcgggaatgttttgacgtctcccgtttctatggtttctactccgtattcactgatccgttcaccgcgctctttcgccagctgacgcattttaatgttgtgatctttagaaccggtaaaatgatgcagtgtggtggcaaactgttcctctgtcacaagccggaaatccacactcgtctcgtattcaaaggtcaggataaccgatacttttgtatccccgcccgctatcacgtcttttacgttcgggagggaaagaagctgttctctgacagcctccggacgatctgtagcgataatgtaatccagatcttttacggtttcccgcgctcttctgagactgccggcccgggaatatttctgaatatccgtcagccgggccaaatgttcttcaatgactgaagcaatgctgagcgcatagccgatcggaaaccgttccggctgttttccggcttctccgagagcctgaaggattttctcctccgtttttttgccgaaaccggcgagcccctgtactttttgctgctcgcatgcttctttcagcgattccgcgtcatgaacgccaagctcctggtacagcttggcgatttttttgccgccgaggcccggaagcttcaaaagaggaaccaagccttccgggacttctttctgcaattggagaagcgtgccggacacaccttcctgcatatattcacgaatgacgccgtaggtgccttttccgattccggataaagacatcatgtcgtcgatttccgacaggctgcggtcatcctgctcaagcgccgccgccgcttttcggaaggctgatattttaaacgggttgtcccctttcagttccatatagaccgcaatcgtttcaagcagcctgatgatatcttttttatgcatactgttaacccccagtcgtttcctgcttttcatcatacaaatttttctcttccggcacaactgacgcagagcttgaaaaaaacttctccggtcaagagaagttttttatgccccgtactgggcccacagttcttgcaggagccccgacagatacggcgtatgatgtgtgatgatatttgcaagcgtcgattgtgcgagcatatcctgaagcacgcttaccggcagtacggatgcgacgtataacaggataaacgcaaataaatagacttccagaaatccaagcaccccgcccagcagtttgttgatctgtttaatgaccggaatgccggcgatgatattaagcgccgctccgataatccggagcaggatctttgcgatgataaacaaaatgacaaacgcgatcgcgttgtaataagccgtctccacgtttcctttaataaaagacagagccgcctgcccgccggaaaaatcaggggcgggtataaagctcagatgcggggccaggtttttgtaaaaaagcgccgcaaacgcaatcgagaggatgaaactcgtcaagtatataaattggaggataaatcctctttttaatccaagcaatgtgcccattaagagcagaactaagatgatgatatctatcatatggtgttcattccttttctttaagctgccgctccagtatttcatatttttcttgcagtttcatataatcatgcacgacattgaccgcagtcaatacagcgagcttatttatatcaagatatggatttttctcgttgatttctctcattttatcatcaaccattccggccacatggcgcatgtgcgctttgctttcttccccgataatggtgaagtgctggccgtaaatgtttactgtcgttttggtttttttgccgtcagacaacgtttctcctccattccgcgagaatcctagttcctatcataccacgattatcgtttgaatggaaagacaagcctcgggctgttatgatacactggtatatacagtgaaaagtgccaaaaaaggagattatatcgtgtcccattctgttataaaagtatccgcttccgctatggaacaaatgaaacaatcctatgccggctcccttactcccgccgttccgcagggcgccgtcttccaggccaagcccccgggctgtaccattacagcctaccgctcgggcaaggttctctttcagggaaaaaacgccggcacagaagcggcccgctggggaacggctgaggcgccgaaggcaaagaaaaccgtcaaaaaagcggccgatccgctttacgctcccccggcgggcattgcctccatgtcagtgatcggctctgatgaagtcggaacaggcgattacttcgggccgataacggttgcctgcgcttacgccgacaaaacaaagctttctttaatgaaagaactcggtgtgaaggattcgaaggatttaaaagatccgcagattattgaaatcgccaaactgttaattaaaaccattccttacagcctgcttgtgttgaaaaacgaaaaatacaatcagatgcaggaaaaaggcatgagccaaggaaaaatgaaggcgctccttcataatcaggcgatttccaatctgctgagaaaaatgaacggcgttaaaccggaagcgattctgattgaccaatttgcagagcccggcatttattttaagcatctttccggacgggatatcgtaaaagaaaaaacgtttttcagcacgaaagcggaaagcatacatctttccgtcgccgcagcctctatcattgcgcgatattctttcttaattgaaatggataagctttcccgtgaggctgggatgacgattccaaaaggcgcggggccgcacgtcgatgaagctgccgccaagctgatcatcaataagggagaaggtgcgctcagaacgttcaccaaacttcattttgccaatacgcaaaaagcgaaacgccttgtagaacggaaacggtcataataaaaaaagcttgcagaatgatctgcaagctttttctttatcctcttaataccgcctgatacgtttcttccagcgctttcagcacgttttcatgtacttttgtcacttcttcttctgtcaatgtttgttcagggttaacatattggagcgagaaggcgacggattttttgccctcttccatatgctcaccttcgtacacatcaaatacggtgacttctttcagcagcgcgccgccggcttctttgatcacggcttcgagctgtccgcttgtaacggttttatctgccacaagcgcaatgtcgcgcgtgacggacgggtacttcggaatcggcgtatacacgacaggttctgtttcctcggtcagaagcgcgtgcagatcaagctcgaacacatacgtttctttgatatccagctctttttccattgccggatgcacctggccgataaatccggcaagcgaaccgttcaatagaatgtttgccgtccggccgggatgcatgtttttgcgtgcagactggacaaattcaacccgatctgacacattcaattgatgcagcaggccttcaacgattcctttggcgacgaagaaatcaaccggctttttctcaccctgccataaatttttgcgccacaatccggttacagctccggcaacccgttctttttcaaccggttttgtgttttcttctttcgtcagaaatacagaacccgtttcatataaagcaacggaatcagtctgtctggccagattgtatgaaacggcttcaagaagattcggcacgagactgtgtctgagaatgcttctttcttcgctcatcggcagagcaagcatcgtgttgaatgatttttcgatcgcaaaagcggccgcttttttatcattcgttaatgaataagtggtcgcttgtgaaagacccgctccttcaaggaaacgtctcactttccggcgttttgcctgatacggtgtcaagccgcctgtcgtgccggccgtttccggaagcgtggacggaatattgtcatacccgtacaatctcgccgcttcttcaatcaggtcttcttctattctaatatctccgcggcgggacggcactgttacgacgagaacgtcttcagcttcactgactgcaaacccgaggcgcttgtaaatgctgatgatttcttctttagcgattgccatgccaagcacggcgttcactttttcaacagacacgtgaatgttgtttgcttcgattttcagatggttttcttcaaccgtgcctgagagcacttctccgccggcatatgcctgaatgagactgcaggcccgttcagccgccagcaaaacgcgggccggatcaatgcctttttcatatctggcgctcgcttcgcttctcagtccgaggtctctcgacgctttgcggacggtctgtccgtcgaaataagcggcttccagtaaaatcgcagtggtgtcttcacggacttcagactcggctccgcccatgactcccgcaacggcttgcgctttttttccgtttgtgatgaccaaatggctgcttgacagcttgcgctcttgttcatccagcgtcacgatggtttcgttttccgccgcttttctgacgacgacctcttttgaaccgaaccggtcgtaatcgaaagcgtgaagcggctgtccgtactcaaggaggacgaagtttgtaatgtccacgacgttattatgcgggcggatgcctgcattcatcagcttcgtctgcatccaaagcggtgacgggccgattttgacgtttttaatgatttttgcggcataatgcggattggcctgcgtatcttcaatcttgacggaaacagcatccgccgctttttctgccgctttttcatatgaagcctccggaagctttacctctgcgccgaggatagccgccacttcataagccacgccaagcatgttcatcgcgtcggcgcggttcggcgttaagccgaattctaaaatcgcatcatcaagctgaagggccgccattgcgtcagctcccgtttcagcatcattcggaaaaacgaaaatgccttccgcatattctttcgccacgagcttgctttcaatgccgagctcctgaagggaacagatcatgccgtgagacgcttcgccgcgcagcttggcttttttaattttgaaattgccgggaagcacggctccgaccgttgcaacggcaaccttctgtcctttatcaacattcggggcgccgcagataatctgcacgggttcctccgcaccgatatcaacaaggcatttgttgagtttgtcggcattcggatgctgttcacgctcaagcacgtgtccgatgacaacgccttttacgccctcccctttatactcgataccctcaacttcaataccggctctcgtaattttttctgcaagcacggccgggtcgattccctgcaagtcaacgtaatcttctaaccatttatatgaaacaaacatgtgtatcctcctcttacgcctgtttaaactgcgaaatgaatctgacatcattggtatagaaatggcggatatcttcaatgccgtatttcagcatcgcgatacgttccacacccattccgaaagcaaaaccctggtattcctcaggattgaatccggccatcttcagcacgttcgggtgaaccatgccggcgccgagaatttcgatccagcctgtttttttgcagacggagcagccttgtccgccgcacttaaagcaggtcacatccacctcgacagaaggctctgtgaacgggaaaaagctcggacggagcctgatttcacggtcttggccgaacatttttttggcgaccaattcaagcgtgcctttcaggtcgctcatgctgattttgcggtccacgacgagaccctcgatctgcatgaactgatgggaatgtgtcgcgtcatcgttgtcgcggcgatacactttaccgggacaaatgattttgacggggccttttcctttatgcttttccatcgttcgcgtctgcaccggtgacgtctgcgttctcatcagcatttcttctgtaatgtaaaagctgtcctgcatgtcgcgggccggatgttccttcggcaggttcagcgcctcaaagttgtaataatccgtttccacttcagggccttcttcgacggtatatcccatgccgataaataaatcttcaatttcttcaataacgaccgtcagcggatggcgtcccccgatgtttacctgactgcccggcaacgtgacgtcaatcgtctggctgctgagttttttattcatctcttcttgttcaagctgttcatttttcgccgtaatggctgctgcaatgcgctctctcacttcattggcgagcgctcccattttcgggcgctcttcggcggacagtttgcccatgccgcggagaacttctgtaatcggccctttttttccgagatattgcacccgaatgtcgttaacttcttttaatgaacccgccgcttctactttttctgcagcttccagttcgagctgtttaagcttctcttccatcatgcatcctccttttatgtaaaccaaaccgttctatgcctttttcagaaaacaaaaaaacccgccccttgagagaagggacgagttgtggccgcggtaccaccctttttaaggcagacttcatctgccgacagcttcattgacataacggaaacgatcgttccggttcacctttacgcgcgtttggcgcggtcccggtgacaactcgagaggtgaaaatcaatttctgtgctgcgataaaaatgctctcagtcagcggcattttctccctggaaggcagcgtgtgcaaaaattgacgtcctctgtcacggtttttacattattgctatctattatagtgaaatccaaggtttttcgcaacctatcctctgagatgataaacgaggatggcggccgctaccgccacattcagcgattccgcctgtccgtacagcggaacgtacagattgagatcggttttttgcagaaggccggcgtccactcccgccccctcgttcccgacgattaacgcgaacgattcttcaggcttcacgctttgataagccgcaccgttttcaagcgccgtgccgtagatcgcgacgccttgtgatttcagctcggcggtaaactcatcaagcggacgttttaaaatgggaatatgaaaatgagatccttgcgctgaacgcagcgtttttccgttgtacgggtctgccgttccctcaccaaggacaacggcgtcgattcccgccgcatctgccgttctgatcattgttcctaaattccccgggtcctgtacggcatcaatcagaagcagccgcttcagctgatcaggccgcttatccggcatatggcagaccgcggcgatccgctgcggcgtttccgtttccgtcacggctgaaaacgcgtcttcgctcagcacgtagcacggaatgctcatatccagatcggccggaatggcgctctcatcgtttacgagaatttcttttaccgttccctttgatttgagcgcttcttctgccagatgctctccttctatcagaaatgtattcgttttaagtctctctttttttgtgtgaagttttttccagtccttcactttttggttttttgcagagtcgattcgtttcactttatgtctgtgctctccttttttcatgcatgttgttattatatctcaagaacagcacataataaaccgcgtgcgcggtaagaatatgcgtatcacattcaggaaaaaggagcggttgtaatggatcttaatttacgcaacgccgttattgccaatgtaaccggcaataaccaggatcagctggagcatactatcgttgacgccatccaaagcggtgaagaaaaaatgcttccgggcctcggcgtcttattcgaagttctttggcagcatgcgtcagactcagaaaaaaatgaaatgctcaaaacacttgaaggcggattaaaacctgcgcaataagcatgaaccgggtgatggcacacccggttttttttgtataataatggcgagggggatcgccatgcagttacagccggaactggcaaagaaattgattgccgaagtcaaacatatgtacagccgcgaagtgattattgccgatacaaaagggatgatcatcgcgggcaccaatgaggcgcgcgccggatggtttcatgaaggcgcactgatctgcgcccgcgaaaaacggaatgtcatcattacgaaagaagatgaaaaacgcctccagggcgtaaaagcaggactgaacctccccgttttttcaggccatgaggtaatcggagtgttcggtctgacaggagaccctgacgatatcctgcctttcggagaattgctcaggaaaatgacggagctgtttattaaagaaacgcgccatatggaagaagcgcagtggcgtgcgagaatgcttgaatcctttatggttgattggctgcagctgaaagaatggtctccgggctttttagaaaaagcaaagctcatcggcgcagaccttcacgcataccgccggatcatactcattcaaggacgttatgagcaatataaagcggaggagctcgggcggctctggcagaacgaatgccctgaagacctgtttgtccgctggggaaatgaacgcattctcattaaccatgaagcaaattcggcttccaaaacacagctcatcaaaaagatcggcgccgtttttgggcagcctgtcaccgccggcatcggacggatcgttccgggagagcgcctcgcggaatcatacgaacaggcggataaagcactttcagccggaatcggtgacaagcaggccgtctttgaagaagatttaaaactggatatgtgtattgccgatatcgcgcccggcacgaggtcggaattttcacggcgggttctcgagcatgtactcggccgggaagaacttctggatacgctgcgcgcctttttcgaccggcaattatcgttaaagcgcaccgcagacgacatgcatattcatatcaatacattgcgctaccgtctttccaaactggaatcactgacaaatatgaagcttgaccgccccgaagacataacggctttttatttggcgctccgctttttagatcaacatacaaaaagcacgtaatcatatcatcatttttcatatgtttctccatagtgtgaagaatcgtttttctttacaattaaatgaaaacgcttttcttatcagggaggttggagaacatgatttcacgagaggcaaaagaagcgttcatccggacggtcgggaaggagaattatgatgattcggcggctggccgtcttgtgtattcttacgatgcggctcctcagctgcaagccatgccggatgcggtaatcgctccccgcagcgcggatgacgtgtcccgtatattaacgatttgcagcaggcatgacattccgatcgtgccgaggggttcaggcacaaacttatgcggcggcacatgtccgtctgaaggcgggcttgtgcttttattcaaacatatgaaccgcattcttgaaatcgatgaagaaaatttgacggcaaccgtccagccgggcgtgatcacgcaagatatgattcatgcggttgaaaggaaagggttattttatccgcctgatccgagcagcatgaaaatatcgacgatcggcgggaatattaatgaaaattccggcgggctgcgcggtttgaagtacggcgtcacccgggattatgtcctcggccttgaagccgtcttggcttcaggcgatatcatccgcacaggagggaagctgacaaaggatgtcgccggttatgatctgacccggcttttcgtcggatcagaaggtacgctcggcgttgtgacggaagcgactttaaagctggttccgaagccggaaacgaaaaaaacgctgcttgcactctatgaacatattgaagcggctgcggaatctgtttctgccatcatcgctgaaaaaatcattccggcgacactcgaatttctggatcagccgacactgcaggtcattgaagattacgccaagatcgggcttccgaccgatgcaaaagcggtgctgctgatcgaacaggacggtgacatcgaaacggtcagacgagatatggaaaaaatcgaagccatctgtaaaaacggagcagccgtatccgtccaaacggccgaaaccgaggaagaggcattcgcgcttacagaggccagacggtccgcattatcagcccttgcccggctgaaaccgacgacgattctggaagacgcgaccgtgccgagatcacaaattgccggcatggtcaaagccattaacgagattgcagaaacatacggcctgtccatctgcacattcggccatgccggagacggcaacctccatccgacgtgcaccaccgatatccgaaatacagaggagatggaacgtgtcgaaaaagcttttgccgccatttttgaaaaagcgattgagctgggcgggacgataacgggtgaacacggggtcggcatcgtaaaagcgccgtatttagaaatgaagctgaaaacagaaggcattaccgccatgaaagcgatcaaacaagcgcttgatccccaaaatctgctgaatccgggaaaaatattcgccaattcatcaaggaaacgcgtggtgatgatgaaatgacaacggctaaagagcagcaacacattcaaacagaattcaaaaaccgcatggatgaaggtgaattgctgaactgtatgcgctgcggcttctgccttccttcctgtccgacctatatcgaatcaggatttcaagaatcccattcgccgcgcggccggatcgccctgatgaaagccgtcacagacggactgatcgaaccggatgaagatgtcgagcgctcactttcgctgtgtctcggatgccgggcatgcgagcccgtttgtccggcaggggtcaattacggacagctgcttgaagaagcgagggatatcattcatcaaaataaaaaacataagcccggcgtgcgcctcttgcggaaagccgccttcaccgggcttttccctcatcaaaaccgcatgcaggcagccgtgaatcttctcggaatataccaaagatcgggactgcagaccgccatcagaaaaaccggtatgctgcgcgttttgcctgaacatctgcgcacaatggaacaagtgctcccgcccgccccgaaacggaaagacatgaaggaaaggccgcgttttcttcctgccgcgggtcccgtccaaaaacgggccgcttttttctcgggctgcttaatggatacgatgtttttagcaacaaatcatgcgacaacggcgcttttacaggcggccgggtgtgaaatcgcggttccggacggccaggcgtgctgcggcgcgcttcacgggcacagcggagaaaaagagatgggaaaagaactggccaagcggaatatcgccgcttttgaggcgcttgacgctgattatatcattacaaacgccggcggatgcggcgcctttcttcaggaatatccgcatttactgaaagatgaacctggatgggcggaacgtgccgaacaattcgtccggaagctcaaagacttttcatccgtactggttgatctgaagttccatcaaaaaaacctgcgggcgcagtctcctcatatcgtcacatatcaggactcctgccatctccgcaatgtgatgcatacgtcagaagaaccgcgcacgcttttgaaaaacattaaaggggctgagtacagagaaatggaaaaggccgacagctgctgcgggtcggcgggaatttataatataacagagtcagaaatgtctatgaaaatattagacagcaagatgaaagccgccggaaaaacggaggcggccgtcatcgtgacagccaatcccggatgccttctgcaaatgcagctcggcattttacgcgaaggattaacaggccgtgtccgcgcggttcatttggcggattaccttttggaagcggcggatttgtcataagccgaaagcagagagaccgatcggctctctgcctttatgatgctacaatgttcggatcggccgcggatttatccgggtattgaagcttccagtctggcactcggatcacgccatacattcgcccattttttcacagccgcaatgataatcacaagcccgagaatcagcatgataatggataaaacgccattcagcacgttgtatcccgccgcttcggggttcaaatacacataccgcaccatccaataacccgcatagttgacggtcacgtacaaataagcgagaggaatcaggcatgtcagcatatagcgccgcttatccgctatttttaatacgacggtcgcaccgatgattaagccgacagatgccataagctgattggatacgccgaacagcgcccaaatggaactgatgtcgcccgaatacagaagatagccccacagcaggcaggcgagcgcgcttgagaaaatcgagcccggcagccagtctgtttttttcagcggcttatagacctctccgaaaaactcttgaatcaagtaccgggcgacacgggttcccgcatcaatcgccgttaaaataaacaccgcttcaaacataatgacgaattgaaaaaagtatgaagccaaatgactgaaaaacggaatctccgtaaagatatacgtcattccgacggcaagcgtaacggctccgcccgttcttccttccagactgagcccgatttctttactcaattcaggcagatggacgacattcatcccgagggcgcggaatatttcaggcgtgctgttaatggcaaaatagtcggcgggctcaagagcggcagctgcaatgagcgccataattccgacgagacattccacaagcatcgctccgaaagcaaccggttttatatcactccatttatccagcattttcggcgttgtgccagaaccgacaaatgcatgaaagcccgaaatggcgccgcaggcaatcgttattgaaataaacggccagacaggacccgcgatcaccggccctccgccgtgaataaactccgttacggccgggaatttaatggcgggattgacgaaaaagacgcctgcgatcaaagcggcaaaaaccccgattttcataaaactgcttaaatagtcacgcggagccagcaaaagccaaaccggaagcgccgcggcgaaaaacgcatagacgggaagcgccactgcaagcgttttcgcatcaagtgtcagcatgtccccgagagccgttgtctgcagccgcggcccgattacaacaccggccattaacaaaagaaacccgacagttgatgcgagtttgagattgcccgtttttttatagtagaggccgacccccatcgcgatcggaatcgtaatccccaccgcaaacgttccccacgggtttttctcaagcgcgtgcagcacaaccatggacagacccgccatcgtgatcgtaatgataaacagcatggaaagaccggtgcaaaagcccgccaccgggccgagctcttctttggcgacttcagaaagcgttttcccgtttttccgcattgatgcaaacaatacgacaatatcgtgcacggctcccccgatcaccgctccgattaacagccataaaagcccgggcagatagccaaactgagctgccagaatcggtccgacaagcgggccggcagcggcgattgccgcgaagtggtggccgaatgacacccacttattcgtgggcacataatctttcccatcctcaagcacatgggccggagtcggtgtctgatcattgatttttaatactttgaccatcataaaggtaccgtaaagccgataggcgatcgccaaaatacatatagacgctatgacgattgtaatcgcattcatttaatcccagccccttttctctttttctaaatattatcataattatcagataacaggagatgatttttgcgtaaaaaaaagccggcagcggcagcccggcttttcggaacattattttcctgataaacggatgacattccaggacagcggagtaaaatgtgccgttatcccttcagcgtttgccgaagacgttccgttggagtgaggaatgacttcttttctgtttttttgattggttgctttcatatcctgatgctccagcacgatatgctcaatgatgcggtaatcttcaaaccccctcagtttgatctccgtttccatcggttccttgcttttgttgacggcaaaaatggtcagtgcttcatcctcttcatggtaaacggccgcggcatcaacatacggcacatccgtaaagtccgccgagtcgtatttcggggaggtgatcagcagcttcatcgaagtccctctcccgtagactgaggcgtgcatgtaagggtaaaagatcggctgcctccatgcttctccgcccttttcagtcatgataggcgcaatcacgttgacaagctgggcgagacaggcgatcttcagtctgtccgcatgctgcagcatcgtaatcagcagtgaaccgatcaacagcgcatcttcaaaattgtagatgtcttcgagaatcggccgggccgtaatccatggctccacttttttatccgcttcatttgagtgataccacacattccattcatctaaagaaaggtgaatcgtttttttgctgcgttttttcgctttcatataatcacatacggctgtgacggatttaataaaatggtctaaatccatagacttcgccaaatagttctcaagatcattttcatggttgccgtaatacgtatgcagtgaaatgtaatccacatgctcgtacgtatgctcaagcacctcggcctcccactcgatgaaggacggcatgccgctgtttgagcttccgcaagccaccaattcgatcgtcgggtccgtccatttcatcacctttgctgtttcagcggcaagccgtccgtattcatgcgccgttttatgaccgatctgccaagggccgtccatctcatttcctaagcaccatgttttgatgccgtaaggtttttcatatccgtgcgattttcgtaagtcgctccagtatgacccttcaggatggttgcagtattcgacgaggttccgggcggcatcgattcctctcgtcccgagattgaccgccatattcacttcggcgttcacttttttcgcccacgttaaaaattcattcgtccccacttcgttcgtttctgtcgtctgccatgccaaatcaagcctccgcgggcggttcttcaccggcccgacgccgtcctcccaattgtagcctgagagaaaattccctcccggatagcggatgaacggcacttgcaattccttgattaactcctgcacgtctgttctgaaaccgtccttgtcggctttcgggtgtccgggctcataaatgccttcatacaccgcccggcccatatgttctataaaagatccgtacatccgtttgtccacttcaccgatgatatattctttatctgctgtaatccccgcttttttcattacatttcctccctctctctatcccttcactccgcctactgtgaggccggaaatgaagtatttttgaaaaaacaagaatatgatgatcaccggcagtatcgcaaaaacggacccggaaatcagcatgtcatagttgttgccgtacggactcagcagccctgaaagtccgattggaagcgtaaacatttctttcgaccgaagcacgatcagcggccataaaaagttattccagctgtttaaagattgaagaatgatcattgctccgaatgccggtttcatgagcggcgccataattctgaagaaaatgccgaattcggtgcagccgtccattctcgctgaatcaagaagatccttcggaagtccgagcgcatattgccggaaaaagaacacggcgacaggcgacacaataaacggcagaatcacccccgtataagaatcgattaaatgaagacccaccgtcaatttgaacaacgggagcatcatcacttcaagaggcaccatcataatgatcagcacaagaacgaaaataatatttctgcctttaaactcgtagacaccgagtccgtagccgatcaaagaggaaaaaaacagcgtgagaaccgtggtgaggacgccgagcagcaggctgttaaaaaaccatttaaaataaatgctccccccgttgaacaaataggtgtagttatcaaggctcatcacatccggatcaagacgcagattcagcccgatgcgcatcagctcagatgacggctttaatgaaccgagcaatagacagatcatcggaaagatatacaacaggctcagcatgataaaaaacaaggtaaacgcgactctgtacacggaaaacatgtgattgttacgcaacgcttatccctcccctttaaacgaaccggacagtttcagtgaaacaaggctgactagtaagatgacaagcaaaaggacaattccgattgctgccccgtaccccatttcgttgtatgcaagcccctgctgatataaataaccgacaagcgtgaggccgatattgcccggggaattattctgccaaagcacatagctttcctcaaacattctgaaaccgccgatcatactgatcgttaacacataaacggacaccggctttaaaaatggaagggtgatatgccggaactttttccacgtactcgccccgtcaatttcagccgcctcatacaattctttcggcacattttgcaaacccgccagaaagtaaagaatgttaatccccatccacctccatgacgcaagcagcaccattaaaaacatgccggtacctttgttgttgagccagttttggggtgatgcgccaagcttcatcatcagctcgtttgcaagcgacgtattcatttctccgaacatcagccggaaaataatccccgctacgatcgtcgatgttaaagccggtacaaacagagccgatttaaacacatttctgaacctgacgagcttcgaattcagaatcaccgctaaaagaagcggcaccggaatcagcacgatcagcgtccagaaagtatattccaatgtgttaaataatgccgtataaaaggttggattaagaagagcggtataattggaaaacccgacaaatgtaatttctcccggcagtatccgctgaaagctcatgataaacacgctgatgatcggatacaaaaagaaaacgagaaacgaaatgataaatggcgccgtaaaaagataaggcgccgctttttttgaatacagcacattgcgccggcgcggcttcttccggactgcagaaacggtttgcgctgtctctgtctttacaggtctcataaaagctcccccgctttcactgttaaatagggcggcttctcctatttttctaattgctctgccgcctcgtccaaggcttcctcaggtgttttttcctgcgtcttcagcgcatcgaacagcacctgtctgacaacgagatcagccgctttagagaagtcttcatgcagataaatcggattgatctcatcttttatttcaaggagcgaggaaaaaattgacgtaccgttccggaagaaatccgtgtacttgtttttctccttcaattcttttgaatcccacacgtcccagcggagcgggtcaaagccgagcaccgtccacagctttatgttcccttcctttgaacctttcgcaaatccgagaaattctttcgcgagctccagatgttcagcctgcttcggcacgacggtggctgttccgcctaaacccgctgatctgtcaccgccttctttccaggccggcatagggtaaatcgccattttcccttttaaatcaggcatataatcgataaaccgtcccatgtaccaaatgggcatcagcactgaggctgccccgccctgattcataaaaccgtagtattcttcgctgtgatggccgccgccgggagccggcagaagggttttatcatttaccatgtcctttacatcattcagtgtatctgtattcgtcttgctgttcagaatcaattttccgtttttgctgtagtagcctgacccttgctgcgaaatcatggataggaatgtggcggagtcgtttgtttcaaccgttcccatcggtttcccagcggcttcacgcactttttttcctgcccgccggtaatcttcccatgtcttaatggaggcgggatcaacgcccgcttttttcatgatatccatgttgtaaaacatgacggtcgtccccacatgtgtatcaaggccgtacaattttccgtttttgctgtataaggccagacgcgcttccacaaacttatcgcggtctttttcaatcagcggcgtcagatcggcaagcgggatatccttccccttcagaaagttcgagaaccggcttaattccacgtcggctatatcgggaagcccctcacccgcgatcagcgaaaccgataaattatcatgcatttgtccataaggataaacaacggtattcagcttgattttgcgatccggatacttctgattccattctttgaccatttcctgataaaactgttcgtgcagaccgttaaacgtccaaaacgtcagctccgtttctcccggccggccggcagtccgttcttgtgaacagccggcggtaaacaagaagagcatcatcagcaccaaacatacagcggtcgtttttttcatgtcattaccccttccactttaggccgtgcggctattgatgcaaatgatgtgcaaagagcgctgcattttcatttatgatggttaaaccggtataacggtctcgcagtgtgtgcgcatgcttaagcgcatcgctgacaaggtccttttttacaccgatctcatcgaaacaggcgggacctcccgcagatgagagccacccggcaattgttttgccgtcgggaagcccttcatatgcggactgaatcgcctcgcgaaagtgcggcggcagttcagcaagcttttcgtgacaagccagttctttgtaaatatcactcagcaccgcgcacgcacagccgaccttcgcaccgtggagaatcggaggctgttttgccttcagcatttccatctcaatccaatgcgagatgtgatgctctcctcctgaggcggggcgggagtggtcaagagcaagcatgacaagacccgaaacgatcagcgcttccatcagtatctgaatgccggcctccgttcccatggcaatgtcagcgcggtgatcaatgcactgccaaagcgcgtctttcacaagcttcgccccggcttctgagtacggctcacccgcaagcctgcgggaaatctcccaatcagccagcgatgttattttcccgagcatgtctccgaagcccgcggctgtcattgaacggggcgcttcttttaatacattcgtatcggcaaataaggcgatgggcgctttcgtttgaatcgtcgttttgattccgtttaatatgagcggcgctcccgccgatgtaaaaccgtcgactgacggagcggtggggaatgagataaacggcaatccgcgctgataagcggcaaaccgcgtaatgtcgtgaatcgttcctgaaccggccgctatgataacatccgtctcttccgcgagattgatcagcgtatagaccaatgtcctctcatcagccgcggcggccccggcttcatgctccggaatgatgacttttgacgctttgattccgcctgcccttaattcgtccgcaagcagacgtcccgccgcctcgtacgtgttccggtcacagacgatgaccggatgattccagcattttttttgcagaaatctgagaagctcttcttttgcattcgccccgatcacgatatcttctatttgaatcggtgagcggctggccccttccttgtcaaactcggattgaatgtcctcaggagaacgtttcataaaaggattccctccttcgctaattctgtcaggtctttaatagaatcaaggacgatgtcaggttcatatagacggggctccccaagtttggccgaccccgtcagaaccaatatgcttttcattccgtacagcctgcccattgcgatatcagattcgaggctgtctccgattatggcgcattcctcagggggaagtccgagcgcttcacatgccgcctcagccatcagccaagacggtttgccgatgacaagctccgtttttgctccggcggatgcttcaatggccccgatcattcccgcgacatccatggcatgaccgccttcattcggaaaggagcggtctttgttcgtggcgatgatgcgcgcgccggaggaagccgccttaaaagcgagattcagatccttataggtgacggtttcatgcagggagatgacaagccagtctgccgcctgcgggttttgcgccaggacgacacccgctaaagcgagttcatcagtcagccctttctctcctaacacccagacctttgacaaaggataatgcttctttaaaaatgatgccgtcacactggaggacagcacgatgctccgttcatccgtgcggataccggcacccagcagtttctttctgcacattgcttttgatagattgccgcggttgcttaaaaagacaacggctttgcccagtgactgaagggtatgaacggcttcttttgcgccgtcaatcagctcccgccccctgaatacggttccgtctaaatcaatcagaaacccggctgcgtcaagtttggccataataagcattcgccccgtgttttctgtaaaaatgcttatcatgcagcactctgtcgatcggactgagctgtttgttcagcataagcgaatggtaggccatttccgctaccgtttcgagcacaacggcgttatgcagggcattcagcgcgtccgttccccagcagaacgggccgtggctgtggacgaggacacccggattttgttcatacggttcgttttgaaaggtttcggctataactttgcctgtatgatactcgtaatctttcacaatttcttcttcatacatttccctcgtgcagggtatagcgctttcaaagtaatccgcgtgagtcgttccgagagcgggtatgtctcttccggactgcgcccagctcgtcgcccagcgggagtgagtatgaacgattccgccgatagccggaaacgctttatacagataaagatgggtcggcgtgtcagaagacggtttcagcgagccttccaaaatgtctccgtcctcattcaggacgaccagcttgtcagcggtcagctcactgtaatcgacaccgctcggtttaatgacgattctcccgctctctctgtcaatgccgctgacattcccccatgtaaacgtgacaaggttatgttcctcaagcttcagattggcggcgagcacttcttcttttaacgcttcaagcatggcggctcccccctttcgcaaaatcacggtttttaatggctttcaggcgtttcatgacattgttttctttgccgaagtagtgtacgagctctttatattccgcatataagctgtcataaatctcagctctttcccggttcggggcataaaagccgtcttttaatttccccatatgcgcgcaagcttcagcaatattggagaatcctccgttttcccgtcccgcggcgagcgctccgaaaatcgcggagcccagtgcaggcgcctgcggagatccggataattgaatgtccatatttgtgacgtctgcgtaaatctgcatgacaaacggatttttttcggcgattcctccggctgcgtaaagctcctcgaccggaacgccgttttcccggaacgtttcgataatcatcctcgttccgaacgccgtcgcttcaatcaatgccctgtagatttcttcgggcttcgtgtgcagcgtcatgccgagcatcatgcccgtcaaatcggcgtccaccaaggttgaccggtttccgttccaccagtcaagcgcgagaaggccgctttccccgggaacaagttctgctgcttttttgctgagcagctcgtgaatgtctatgtgtttatcctcagcttccttctcatagtctctcggaacgcacgttttgacgaaccattcaaagtggtcgccgacacaggactgccccgcttcatatcccgcatatccgggcaaaatgccgttattgacgaccccgcacataccggggacgatatgttcttcctcgccgagcagcacatggcaggtagacgttcccatgatcatcagcattttccccggctctgtaataccgaccgcgggcactgacacatgagcgtcgacattggcgacggcaacggccgtccccggcagaagcccggtcagctccgccattttttcggtcaaacctcctgctttttccccgactgaataaatcgcgccgcttaatttatcctgtgtaatcgttttcattaacgggttgagcttttcgaaaaaatgatccggcggataccccgtctcctcattccagattgctttgtagccggccgtgcagttgcttcgcttcaatgaaccgcacaattgatagacgatccagtctgccgcttccacaatccgatctgccgccttgtatatatgcggcgcttcttccgcgatttgcatgattttcgggatcatccattcagaagaaattttaccgccgtatcttttaaggaatgtttcttttgtgtcttcggcaatcgtgttcaaacggtctgcatgtttttgagccgcatgatgcttccacagcttcacataactgtggggctcccgttcaaattccggcagcatacaaagcggctgccccgcgccgtctatcggtaaaatcgtgcaggcggtgaaatcaattcctatgccgatcacgtcttttggatcagcgcccgcctgctcaagcaggttcggaatcgccgtttccagaacttcgatataatcggcaggatgctgaagcgcccagtcccgagggagtttttcacccgtcttcggcagcgtgcggtcgatgacggcatgagtgtattcttttaccgcagacgcgatttcttcgcccgtgcggacattgacaagcaccgcccggccggacaatgtgccgaaatcaacaccaatcgtatacgccatatcaattccctcccagccggtataatacgtcattccatttcagctcttttttcagctcatgtatttcagtattgcgggaaataaagatgctttcaatgcctgccatctcagcccagtcaagcatctgttcagccgtaagccggaaggacatacaggtatggtgggcgcctcccgccagaatccatgcttccgcagctgttttcagcgatggctccggcttccacagcacccgcgccacagggagattcggcatatcatgatcaatttccctgccttccgcttcattcagaatgagacggaaccgcccgccgatatcaatgatgctggcgatgatggctgaaccgccgattccgttaaaaaccagccgggccggatcttccttccctccgattgagagcggatggacttcgattttcggctgatcaagggcgatcgtcggacatacttcaagcatatgtgatccgagaatcatcgcacgacccggttcaaaatggtacgtataatcttccatgaaggaggtttgttctccgtccgccattattttcatcattcgcacaagggcagccgttttccaatcgccttcgccggcaaatccgtaccctttttccatgagacgctgaacggcaagacccggaagctgcttcattccgtgcaaaacttcaaaggaggtcgaaaacgctgtatatccgccccgttcgagaaaggccgttaatccgagttcaattttcgcctgttctttaatggaagcaacttttgcttcatcccgcttcgtttcgtcgctgatgacatacaatttgtcgtattcctcataaagcgcctcaatttctgcgtcggtgacattgttcatcacctcggtaagatcgccgattccgtacccgtcaacctgccagccgaattgaatgtgggcgccgactttgtctccgtcagtaaccgccacattccgcatattgtcgccgaaccgggctactttaatattcctgctttcattccaagcggcagccgtgttcatccattgcgaaatgtcatgtttgacttcctcatcatcccaatagcctgcgatgacttttctcgtctgccccattcttgactggatatatccgtactcccggtctccgtgagcggattggttgctgttcataaagtccatatcaatcgtttcccacgggatgtcgcgatgatactgggtatgcagatgaagcatcggcttttgaaaagcggaaagaccttcaatccacattttcgcaggggaaaatgtatgcatccacgtcacgaccccggcacagttttcttgatactgcgcttcccgcaaaacctctctgatcgtttcagatgacgtgacaaccggtttatgcctgatcttgtatcttgatgacaccccgctgagaccgtcacatattccctttgcgtgtttatcgacaagctgcagcgtttcctctccgtataagtgctggcttcccgttacaaaccaaaattcatattctttgttctgaagcacattcatttccccttcccatcaaaataaagcgcttgcatttttaaataaatatacgtacgaatataaataataaaacttttattcttttatttgtacgaacaactttattatagttaaggaggaatcaaactgtcaatcttttattgcaagtaaaaaagccggacacacatgcccggctgatcaattaataggaaggccagcctgaactccaatcgatatcattgatgagcatcttcggaattccgctgttttcggcatcatacgcatgacgcactaaaatattcccgttcacaatgtcttgaccgcccgggcctttccagcggtcattgccggaatcaagaatcgtccctccgccttcagacatgcttttcccgcttttatcgagatatgggccggtgatgcttttggatcttccataagcgattttgtacgtactattcaccctgaacagcatttatcaaacgacaccattaagtaatagtagccgttctggtaggtgatggccggcgcttccaaagctccgccgttattcggtctggcagcgatggaataaagtgatcccgtcggtttcattgtatttttatcaagctttgtcagcttaatgccgctccaaaaagaaccgaaggcaagccaagggtttccgtctttatcaattgtcagctccggatcaattgcattgtagttattggcgcttgtcgaacggatgacaagcccttcgtccttccagtttcccgaactgaggcttgtagatgatgcaagaccgatcgcggaggtatttttgccgaatgaagaaacggcataatacagccaatactttccgttaaaatattgaacatcgggggcccattgattcagcccgtaattcggcacataattgccccaccatgacagcggggaagtaaagattgatttctgaacggtccatacgccgccgctgcccgcctttaagacgcgaagccccctctccccttccaaaccggttccgaaagcgtaccacgtgtttccttccttcgccattgtcggatcgtgaagcaattcatttgatgccccccaaaacgcggcagatgccggagatgaagacatcagaagcagaccggctgtaacgactgcgcatgaaaagcggatcatgcgtctgaatctgtttttcatttgtaaacctccctttttttaaagcgctttcaaaaacatgttgtcagatttttctatgtcttttcttattgtagacgcaaggctcatatttgtacagacaaaaaaaaaagaatctgcttaaaaaagcagattcttccgtatctttattgataagtaatacggtcaaccgtttcccggtctaattttttaattacttctgtgatcaattttaccgtattctcataatcatcccgatgcaaaatagcggcatgagtgtgaatgtagcgcgtcgcgatcgtaatggacagcgccggcactccgtttgcggttaaatgaatagaacctgaatccgtgccccctccggcaatggaatcgaattgatacggaattcccgcttcttccgccgtgtttacgacaaggtcgcgcagccctttgtgagataccattgacgcgtcatacagaataatttgcggcccttcgccgattttgctttgcgcctctttttcagaaattcccggtgtatctccggcaattccgacatccacaccgaacgcgatatcaggctggatcgtatgtgccgctgttttcgccccgcgcagcccgacttcttcttgaaccgttccgaccccgtatacttcattcgggtgatcactgtttttcagattttttaatacatcgatggcaatcgcacagccgatacggttgtcccacgctttcgccaataaatgcttttcattgttcatcactgtaaattcaaaatacggcacaatctgatcacccggaagaacgccccattccattgcttcttcacggctggacgccccgatatcgatgaacatctctttaatatcagcggctttttttctggcgtcaggaggcagaatgtgaggcggtttcgaaccgatgatccccgtgatgtcccctttttttgtcacgacggtgacgcgctgggccagcatgacctgagaccaccagccgccgacggtttgaaagcggagaaagcctttatcagtgatttgcgtcaccataaaaccgacttcgtctaaatgccctgagatcatgattttcggaccgttttctttgccggtttttttggcgattaaacttcccagccggtctgttgtgacatcatcggcaaatggttctatgtatgatttcatcacttgtcttacttctctctcatttcccggtatcccttttgcatccgttaacgctttcagcatggtgagcgtttcatctaattttgtcatcaataaacctcctttttttcactacccttcttattatacaaaaccaatgctgaagcatacgattaattcgcctgaaaaacgggtaaatgtttttatctatttcttttaaaaaaatgaaactttttgttttgtttttcgtattacatcagatcatgacaaaggtgaggaggtgccttcacacatatggccattacagtattgaggattgtcttgcttgcacttcttatttattttatttacatgtgcgtcaaattttacgcaaacccgaaaagaaggctcagactggcgcaatcaaaagagaatttttattttattgacgaacagaaaaacacgcgaaaaaatctccagcttacttataaaggagtgctctttgaaggagaaaagcatatcccttccaaagatcatccgctgtttatccatacaatatttgtatggaccgaaaatccggaaaagctgaaccgcttttctgcagatgattttgaagaagtcgaaaaaaaggtattggagcggtatccgaattgcaagattgattgggaccagcccatcaaaaaagcgaaaaaagcaggcgagcgataagctctcctgctttttattttttatacatcaaatacatgagcacaagggcggcttcagtgagaaaaagcagcggcaccccgtataaaaaggatttgtgcttcgtcttatgcctgaaggtgcgcatgccgatccatacgccgagtgagccgaacatggcggctgtgagccatattcgtttctctgatattctccacctgtgcgcctttgctcttcttttatcagcgcccatgatccaaaagccgtatccgtttatcaatacggcgtaaatgaagagagccattgattgtcaccctttacgtaaaaaaaccgctcccggaaagagagcggctttttcaacttacttgtctaactgagctttagcagcatcagcaagctgattgaaagcagtaagatcgtttacagcaagatcagcaagcattttgcggtttacttcgatgcctgaaagcttaagaccgtgcattaaacggctgtaagaaagaccgttcatacgtgcagcagcgttgatacgagtgatccaaagcttacggaaatcacgttttttctgacggcggtcacggaatgcatagtttcctgatttcatgacctgctggtttgctactttgtataatgtatgttttgaaccgaaataaccttttgctaatttaagaacctttttacgacgcttacgtgtaacagttccgccttttactcttggcattagatttccctcctaattgttccttgtccgattacttgatgttggcaagctgttgtttgatgcgtttgaagtctcctgcgctcacaatagcacccttgcgaagcttacgcttttgcttttgggatttgttggcgaataagtgacttgtgtatgcatgagaacgttttaacttcccagaacctgtctttttaaaacgtttagcagatccgcggtgagttttcatttttggcatgggatttcctccttattgcttttcgtttttcggcgcgagcattaagaacatgctgcggccgtccatttttggttttgtttcgactgtcgcaacttccgcacatgcttcagagaaacggtccaatacgcgctggccgatttctttatgagtgattgcgcgccctttaaagcggatagaagctttcactttatcgcctttttcaaggaatttaatcgcattgcgcaatttcgtgttaaagtcatgctcatcgatcgtcggacttaatctaacttcttttaagttaatgattttttgatttttgcgtgcttctttgtcctttttctgctgctcgaatcggaacttaccgtagtccatgatgcggcagacaggcggttttgcatttgctgcaactaacacaaggtcaagatttgcgcggccggcgatttcaagtgcttcctgacgggacttgatgccgagctgatcgccattttgtccgatcagacgaacttcacgtgcacggataccctcattaaccaattgatctttgctaataatgagccacctccatagtttcttcgaattgattcacaacgctttttgactgcattctgcaggcaaacaaaaagtgcgggcatgacaacacacccacactacgaacatctgcataaataaaaatgtacggtcaacctgccaactacatgaatgtgtcaatcaggtgagaagcgggtgcctctgcttgtgatttatattcaattcaataactattctacacaataccggatcattagtcaagaatgacttctccggatcaactttttcattttaacacgatgccggggtgagcgcaaggaaaaatgtgaaatttcgttctttgccgcccgcggacgtgccaacacaataaaaaacccgggtctatgacccgggtttatcctccgatgagctgaacgaataccggaatgaccagcaccgtcaccactcctacgacgacaaccgcgatacttgccattgccgcttctacttcccccatctcaatgccgaccgcaacaccgagtgcgtgtcctgatgtgccgagagccagtcccttagagattgggtgctttactttaaacagttttaagaataaagcgccaagagcatagacgataacggcgttgaaaataacggcgaaagcggtgatgtcggtgatgccgccgatcccttttgacagcggaagggcaattgccgttgtcgccgcctgcggaagcatgcttttcataacggccgcgtcgagatgaatgccttttgcgatcaaatagacaatcgtgactgagcagatagagccgacaatgatggaagacatgatctgccaccagtattttttcagcttggcacgctgtttgtataaagggatggcaaaagcgatcgtcgcgggctccaggaagaatttaataatgtctcctccgcttttataatcttcatacgaaaaaccgccgagcttcagaaaaagaattccaagcaccatcgcaacaaacagcggggtgaagaggaaaaagcctctcgtttttttaaataaatacgtgccgatgccaaaggccgcaagtgaaacgacaataccgaaatatggactcatccgttttccctcctaatgctgcacaagttcgttttcctgattggaacggcgcaccgtttgtttatcagccggagcagccttctgacgtttttggctgacagacaagatcagctgagaaaaaaggcctgtcgcccctaacagaatgatggtggcgagtaagatgacgagtgcgatctgcacgccgtactgctgcatgacgccaagtgaattcatcacggagatgcccgacgggacaaataaaaatccgatcagtgacgttaatgatgttcccagcgtttctacttgttcaagcttaatcactttcaggcataagaggacaaataataacaccaaacctactacggaagcgggtataggaatggggacaatcgctgcaatcccattagatatgagcataactacggcaaaaataaatgcttgtgtcagaaatccgtacacttttttcgcactcattttcttcacctctttctctttgttaggtccattataaaagagaaatcgatttttaaagcgctttcataacaaacggctgaatattcattctgaaatgcaaaaaacggctgctgaaatgcaaaagccgcctcatataatatgaagcagcttttttaagtccttggcgtatgtacggctgacgggaattttagaaccgtcttttaatatcagattgtaagtcgaattaaaccacggatgaatttccgtaatatgctccgtattcacgatgaacgcgcggtgcactctcaagaaacccgtatcaggcagttttttctcaatgaccgccaaagtttcatgaacggaataagacgcggcaaacgttttgacggaaacgtgtccgtcctccatgccggcgtaaataatgtccttcgtatctaaaatgacaatagattcaccggctgatacagccagtttatgcgctccggctgcggacggcagctccgagacggctcctgccctgtcctgcttcactcttttaaactttctgatcgtctggcgcactctttcttcatcaaaaggcttcgttaaataatcgagtgcgtcgacttcaaaagcttttaaagcaaattggtcatacgccgtcgcaaaaacgacggccggcggatttttcatgtttttcagccgtttggcaatatcaaatccgttttctcctgacaaatcaacgtccaaaaacagcagatccggtttttgatccatcatactgtcaaaagcggattcaatattttcagcttcgtttatgtcacttacttcattcgtccgtttcagcaaataagctaattcatctcttgccagcatttcatcatcaacgattaacaccttcagcatgttcttctcctttagtcatcagtttcaaaggcagctcaaatgatacgtccgtacctttgccggcctcactttccaatcgcagggctgccttggggccgaacagcccgatcagccgctgatttaaattgtaaagcgcggttcccgtcccttctttagacgggagcggacggtttccgagcacggacagcaattccggatcaattccccgcccgttatctccaacccgcattaaaaccgactgaccggcggataccacgctcacattgacggcacagctgtcctgctttcttgaaaatgcatggcgaagcgcattttcgacgagaatctgcagcacaaaaggaggaatttcgatgtcctccaaaccgcgttcgatttcaaggctgattttatatttcccaggaaaacgggcctgctccaatgataaatacgcctgcagatggttcagttctttagaaagcgggatgagcagctgccttgccccctggagattggaacggaaatagacgctgagctgcagcagaagctttcgggttttttctacatccgtacggcaaagagcagaaatcgtattgatcgcattaaacagaaaatgcggattgacctgtgcttgaagcgcttttatttctgcgtctttcagcaatttgctctgcagttccgcctcgccgagttcaagctgtgtggaaaacagcatggcgagtccttctgcaagctcttcttcaacccggcttaaacctgacgggcttttaaagtacattttcagcgtcccgatcgttttgccgtttgacgtcagcggcaatacaatcgccgcatgcagcggacagggatcgtgcgtgcattcaatttcttcctttgatgtcgctttcataatatgacccgttttaataacgcgctttgacaatccggtaatcaggctttcagacggaatatgatggtcggcacccgcgccgacgtgcgccaaaatcttttcgttatccgtaagcgataccgcgtccgttcctgtttgcctgtgaatgatggcggcgacgcttttgcatgagctttcattcagcccctggcggaaatacggaagcgtctgatcggcaatcatcagcaccctgtgggtttcaagggctctcgcccgttcttccttccggataatcgactgaatgatcgaaagaaaaataaaagtccctgacccgtttaccaatatcatcgggatgccgatgatgctcacaagcgtccaagcgtcagaaaacggcttggccatcaagaggatgagcagcatttgcagcgattccatcccgagtccgacaagcgcggccacacgcggtgtcggcatcctgtagcgttttctgaaataccgtccgatccagccggacaaaatgcccgctaaaacggatgagacggcacagctgactgcggtcgcgccgccgagtgataaacgatgcaggccggccagtatgccgacgccgatccccacataggggccgcctaagagtccgccgatttcaacgcccataattcttgtattggcaattgaaccggacggattaatttgaaacacccagtcattattcatgattgtattctgctgaatttctattcccgtatagttgctgatgatactgaacagcgagaaaattgaaatcagcaccgctttgcctttatagctctcaggctgctggagcgcctgtctgaacaatctggtatgagccagaacaaatcccaatatgacgataattccgactctttccagcatcatgatgatcaaatgcagcatacttttcacctgttctttcaaattttattttatcacgttttagagcccgagacagaatctgacacaaacctgcctgtttttttcaaatcatctgaaaacaaatctttcacagtctatgtatctattgtagaataaacgggagccttgcggcagagagtttcagaatataacaaagaggagaagatcatgaaagccgtattttttgatttggacgatacactgttatgggatgaaaaaagcgtcagaacaacattcagggaaacatgtttacaagcggaaaaaaaatatggccttgacccgcaaacatttgaagaggcggtacggaaagcggcacgggaattgtatatgtcatacgaaacctatccttatacggtcatgatcggcattaatccgtttgaaggattatgggcgaatttttccgagccggtcagcgaaggatttaaacagctgaatcggattgcgccggaatacagacgaaacgcctggacgaacggcttaaaaagcgtcggtatagacgatgcggcttacggcgaatatttggcggagtttttcgcggcggaacgcagacagcgcccgtatgtgtatgatgaaacgtttgcggtgcttgataagctgaaaggtgtttatgaattgcttctgctgacaaacggcgatcccagcctgcagaaagaaaaactagccggcgttcctgagctcgcgccttattttaatgaaatcgtcatctcaggcgctttcggaaaagggaaacccgatgcctccatattcgaacattgcctcggcctcctgaacctgaaaaaagaagacgccattatggtcggagataacctcaatactgatatattgggagcgaaacgggcaggcattacgacagtctgggtaaaccggacacaaaagaaaaatgatacggacattgcgcctgattacgtgatcagcgatcttcacgagctgtttgcgattatagagaaacaaaaagaaagataattttatacgcaaaaaaaccccattctgaatgaacggggttttttgtatttccggttattttttcgcttctgctacagcctttttcacaaaatcgtccaatgagacggtttctgatttctgctcgccgtatttccggacgtttaccgcgccgttttccgcttcttggtcaccgaccacaagcatgtacgggattttttgcatttgcgcttcacggattttatagccgattttttcgtcccggctgtcaagctcgacacgcaggccttcgcgctgcaggcgctcctgcacttttttcgcgtagtcaagatgcacggacggtgatacaggaatgacttggaattgcaccggcgcaagccatgtcggaagggcgcctttgtgctcttcgattaagaaagcaacgaaacgctccatcgttgatacgacgccgcggtgaataacgacagggcggtgctgtttgccgtcttctccgacgtaagtgagatcaaagcgttccggaagaaggaagtcaagctgtacagttgacaatgtctcttctttgccgatcgccgttttcacctgcacgtcaagtttagggccgtaaaacgccgcttcgccttccgcttcataatagtcgtgccccatctcatccattgccgccttcagcatggattgcgctttgttccacatctcatcatcatcaaaatatttttccgtatcttcaggatcgcggtaagacaggcggaatgtgtaatcactcagtccgaagtcttcgtatacgtcttgaatcaaacggacggtgcggatgaattcttctttaatctgatcagggcggacgaaaatgtgcgcgtcatttaacgtcatgccgcgtacgcgctgaagacctgaaagcgccccggacatttcataacgatgcatcgttccgagctcggcgatgcggatcggaagctcgcggtagctgtgaatgtcctgtttgtaaatcatcatatggtgaggacagttcatcggacggagcacgagtgtttcattgtccatttccatcggagggaacattgtatcctgataatgatcccagtgccctgatgtttcgtacaggtctttgcttccgaggacaggcgtatacacatgctcataaccgaggctcagctctttatccacaatgtagcgctcgatcacgcggcggatggtcgcgcctttcggcagccagagcggcagaccttgtccgactttttgagagttggcaaacaattttaattctttgcccagttttcggtggtcacgctctttcgcttcttcaagcatgcgcaaatgctctttcaagtcatcctttttaaagaaagccgtgccgtaaatccgctgaagcatttggtttttgctgtcgccgcgccagtatgcgcccgcaaggctcagcagcttaaattctttaattttgcctgtagacggcacgtgcacgccgcggcacaggtcaaaaaattcgccctgctcataaatagagaccgtttcgtcttctggaatcgcatccagcagttcaagcttcagattatcgccgatttccgcaaacatggcttttgcttcatcacggctcacttcttttcggatgatcggcagattttcaccgatgatgcgtttcatttctttttcaatcttcggaaggtcatccggcgtcagcgcctgctccatttcaacgtcataatagaacccgttttcaatgacggggccgactccgaatttcacatctttataaatgcgtttaatcgcctgggccaataaatgcgccgtgctgtgccgcatgatgttcaaaccttcttctgtgccttctgtaatgatttctacggcaccgtcctcttgaatcggcgttcttaaatcaatttcctgtccgttcagttttccggctaaagactttttctttaatcccggactgatggatgccgcgatatcttctgttgtagttcctttcggaaattcctttaccgctccgtccggaaatgtgatgttgatcatatctgacatcttcgtcactcctttttttatgcaaatcaaaaaccccgccccctatgaaagggacgaggttaaataaacggaatcgtggttccacccttttttccgcgcggccgattgcttcggcactgcggctctaagctctgtaacgggagttcccgtcagctattactggcgcttattccggcgttcacagctgaagttcaaaggcggtaaagacaatgatccatagctggaaagctttcagcctgggctctcctctcttatacagccggtatcaatgcttcatgtccttatcaatacgtgtagcaatcattaatcttttatgtattataaaatgtctgtgagaaaaatgcaactcggttttccgtctgatttcgcacagacagccctgccgcttacacaaggccgtccgtgcggctatccttccgtcttctcggctgcaaacgcgcccagcggaaaaaggcgcaccctctcctgaaacacgttttgaatggttcttgacatcatatgttccggtttgtccgtatacagttcgaccgtctcaggcgcaatggagatcagcggcgcaaggagatgggaatctatatacatcgggtgctcccgcacaaaccgtctgtctatgtattttttctgttcccgttcagacacatagcgcagctcccacagcgtaaaagcccggtcatgtacgatgcggactttcttcatccgcggcggattggatgtcacataatctctcagagactggataaagttttgatattcctgttccatccggtattcatctatcgcggcctccgtatattctctgagcctctcataatacctgccgagccggaacgtctgaaacgaacgcacggaaaaaacacccgcatcaagtgaaatcgttcggagcgcatctgaaataaactgtgtgcgcggctctttcttcggctcaaacggatgatcctcaagctctccttccataatgctgtgtgcaagctgaaggatttgctgctgttcatcctgatcggtgaagcagtatgcgtcctcaataagcgaaagcatatgctcgtcttctttgcattccaaaaaaaacctgacaagtatcggctcaataaagcgctgaacgcaaaaagccgtttcagaccttgcgattccgactttttttatgccttcacggacaataaaatgtctccggtcgtccgattgctgaatgagatgtaaaaaagcggcggtatcgtggtcatcttcaaagatcacttcaagcatatttgtccccccttacggcatctgttacaagtatatgggggatgtttttaaaatagacgtaaaggttagctttcaccgccgaacaaatgacgcaccttctttttaaatataacgggaagcgataaaaatacgacgtaaagacagatcacgcagagtacggccagcacattgccggacataaagctcgcgccgagcacattcaggacgatcgtccccggaatgatgcccgctgcggtcgccaaaaaatacgttaccggcctgactttcgataggcccgcggcatagctgatcacatcaaagttaacaggcagaatgcgcaggataaaaatataaaagaagccattggttttcatctgcttttgaatggcttccatttttccatgacggcttttctcattaaaggcaaacagccccgccgcaaaaaaagacgcggcggcagcgcccattgagcccgccagcgtatacatggtgccgaaaaacgggccgaacgccaatcctccggcgacggaaacgattgatacgggaaacagcacaaaaggcctgacgatggaaattccgataaacacaagcggcgcaaaaacaccgaacgataacacccacagccggatctccttaggcgacagattcagatatttgcggtttgcccacagcaaaagacccgctcccgccgcagccgcagcccaagtgacagccttcttattcctcattccctcaaatccttcccattggacgccggcatcatgaacggcggcggttttccccgtcaagacggacgggcgaagccaaatataaaatccgctccatcagtcttgccgcttttacttcttccttttctccccgctgtgaatacgtaaaatgatgcttcagctcgtctggtgaaaaattagacgagaagaaagtgggaagctgctggctcattctgtgctgaagcacggtgccgatgacttcatccctgacccagcttgtcattgactccgctccgatgtcatcaagcatcagtacgggcgtcgttttcaccatattcagtttcgcctccagcgactgatcctgaagcgagtttttcagctctctgacaaattcgggaacatatacgatcattgatgaatactctttttccgccagttcattggcaatggcggctaaaataaatgtctttccgattccgaattttccgtacagatacagccctttgccttttcccgtttcattatagctcttcagaaaatccgtcacatgctggaaaatgccgagtctgctcggatcggtaatgtcgatctgctgaaacgtcgcgccgagaagatcctgctggatatacatgctcttcatcagggacttttgccttttctggcggtcgagctttctcttttccggacattcgtaatattcaatatcaatggaacgcccgttgatcacaagcttcggatggtagccttcaagcaggctgttcgtccggctgtctttcgaacagaaggcgcactgtttactttgctgaacgaattcgtacagtttatttaaccctctgtcaatcatgctttgattgataacatctttctgttccttcaaaaaagcctggacgtcttcgtcggccataacttgctgctgcattcgttccaggcgtttttgaaagtcaggtcttttcgtcacgccttctaaggatcggctgatcggttccattcaatatcaccccgcttctctgtctcaataggcagagtattttttcagttttttcatttcttccatcatttttttcttctgttcttcaagatcctgtgcggaaagagccgtctgttcttgtttcttcccggtttcttcttctttcatccaatcagggcgcttttcttcccggacggtttttttgccgcgcgccgcgccgtttgttttgccgtccgcccaatcaagatattgcctgtgctcttcgattgcgagcttcattgcttcccgtaccgttttgactttctttctggcccagtgggcggcgattttttggatatagtttttggacagcttcatatccgttttcagcatgacataataaatcagcacattggtgacgccgggctcaagcttttgttcgaacataatatcggcgataatctgcaggtcggcttttgacggctcggtcccgtccgcaatgtcctggagaagctttctcggtgatatggtctcaagctgtgcgatgagttcgccgttcaatgaatcgtccttttccgtccggttttctctcaaggtgacaggctgtgttttatcaatcagttcgggaagcttgccgcttctttcaatttggtaccagtcgctggccgctttcctcagcgcttcggccgttatcgtatcctgctcattaattgcggtcatgacgacgtgctgcatggagataggatctattccgtataaatatgaaagctttttaatgctctcccgcacatcctgtgtgattgatttgcgcggtatcatcgtttctgataaccccgccaaaaacagctcaaaatcaaacacttcctccgtcaccgtataggaaggcgcttgtccgacagacgccgtctcatagtcctcggggagcttcatcgcctcttccatatcaggcgtcattttccattcactcggctgaaaagaggcaaaagcgtgattaaacggacgggtaatttcccttgcgcccgcgccgacggaagggtgcgtgtaaaattgtctcagctgctggtatttcgttttaccgactctgttataaagaaagacattcagcatgccgtcttcaaaaaaatcattcggcctgagcgggggcagcagctcataaataaacatccgctctttttgctcggactcccggatatacactttcagcagtccgattccttcaagctttccctgttcatgatgaatcttttttaaatttgactgcatcatgcccatcagctgcctgtgcgtggattccgctccccacaagcggttctgctcaagctccccccataaggtcatataaagggagaatgcaaaagaaccgatcagcggctggtacagatgtgtcaaaacctgtctgtcgacatcctgaagaagcgaacggcttttgaccgtataaggatctacaggcaatacgtcattccaatagtcagccatgattctcaaaccttccgatatgtttctactctcattttacaccgtttctgcgatctatcaaatgccaattttgctcatgagaaaagagccagacacaatctcttagctctctcagcgttctttctttattaaatctttcaattcatcgataaacacgtttatatccttaaactgccggtagacggaggcaaagcggacataagacacctcatcgattttcgccaggcggtccattaccatttcaccgacaagttcgcttttgacttcagatacgccttggtttctcagctctttttcaatgtcaaagcacatgtcttccaatgttttcaaaggaacgggccttttttcacaagctttaattaacccgcgcagcattttttcacggctgaattcttcccggacgccttcttttttcacgacgatcagaggcatctcttcaaacttctcaaatgtagtgaagcggtaatggcaggcttcgcattcccgccttctgcggattgatttcccttcgtccgcaggccgtgaatcaagtacgcgggaaccgttatgctggcatgaaggacatttcaaattggatcagctcccatctgtttcgttgctgtaatgcggttcgcaagcttccggtaaatgcccgccaacgtttctaggatgagcctatttgttgggagagccgatagaccggccttatcttttctattttacaaaaaaaatgcttaaagaaaaagcaatgctgtttttttacattagaaaaggagcatcagcttcaaagcgcgtaatggctttttcagcttagctcccttgtgtttgcgttttgaaaattacagtactttcgcttgtgcctgtttaatctgtacaggccccattcctctcggtatttcaatgttttctcttgtatctgcatgtaatgcgtccgcaatgtaatccgcagccacattaggatccaggtctccacaagtataaacatcaatgcttgcatatccgtgttcaggaaaactgtgaatcgttaaatgtgactcagagataataacgactccgcttacgccttgcggtgcaaatttgtgaaatgcgacctcgcgcacttcagctcctgatttcaaagcagcatttacaaacgttttttcaataaaatccatgtcattgagcttatcaaaatcgcatccccacagctcggagatgacgtgacgccccattgtttccataatcatggacccccttaacaagaattaaaaaagtgaatttccgagaactgacccggccatttaccacgggggaaagttagtccggagaggtcctaaccctttaagtaattccgaagcagtcacgagcaagaagttcacgaaagatagtatactgtgtttaagtttattttgcaaggtgtgttttttgcgaatatgccgttaagggtttttttctaacaaatgtccatgatctttagtctacacagctgacgggtgtttcattcgcgcggcgacgtgacggataagatcaacgacccggcaggaatatccccattcattgtcataccaggcgagcacctttacttttcggtcttccatcaccatcgttgtcagtccgtcgatgatcgcagagtgtgaattcgtattataatccgaagaaacgagcggctcatccgaataatcaagaattccgtacatcgacgtttttgaggctctttggaaagcggcgttcacttgctcggccgacacatctgttttcagatcgcagacaaggtccactaatgacacattcggaacgggaacacgcaaagcgagaccgtgaagttttcctttcaaatgaggcagcacgagcgacagcgctttagcggcgcctgtagaagtcggaatgatggattctccgcacgctctcgccctccgcagatctttatgcggattgtcgatatttttttgatcattcgtgtaagcgtgaacagtcgtcatcagcccgctttcaatcccgaattcctgatcaagcactttgacgaccggcgcaagacagtttgtcgtgcaggatgcatttgaaataatgacatgttcatcgggattgaactgctcttcatttactcccatgacaatggtaacgtcttcatttttgcccggagccgttaaaatgacttttttcgcccctgcttcaatatggctcatcgctttttcttttgaattaaatttccccgttgcctctacgacgatgtctattccgcattctttccacggaagctctctcgggtcccggcgattgaacagcataatatgttttccgttgacgatcaggctgtcgtcggcggtctcaacttcttgatggtatttgccgtgaattgtgtcatactttatcaaatgagcaagcgtttccgggggatagcttgcattaatggctgttatttgaatttgatcatcttccattgcttttctgaacaccattcttccgattcttccaaacccgtttattgctacttttaccttcatgctcaggtcacccctttttaatatgccactctaatttacctttatttatatatagtataacacattaaaagaaatccgccagtacaacttgataaaaatccacccttataccgatcaatatgttgttcaatcggtttttttgcatataaaatgatttttcttccataaaaaaagcaggatcagcgtctcaggctgcctgcttttttcttatatttgtcccggttctttaaatttgtcattcaaaatgctgtcctctaaaacggaagacacctcgccgtaccgtttagcaatatgcatcgcgccccagtcacacagcgcatttaaaattctttccagactgtgcccgtattcactcagctcgtattccactttcggcggcacctgattgtacacgatccggttgatgacgccgtcagcttccagctcccgcaattgctgtgtcagcatcttctgggtgatgtccggcataagccgcttcaattcgcttgtccgttttttcccgcgcatgaggtggcagaggatcacacacttccattttccgccgatcacttcaagcgccgcctctacggatatattgtattttttcttcagcaacggtaattcctcctcatctataggaactaaaaagtgcctatggcacttaaaagtacgttcttttcaatgacacttctatcaatcataatgacatttgccggctgaaaaggaatgtactcttatacttatatcgtttacccggcatcatttcaaccatacattatcgtttaaggaggaaaacagatgtcttcacatcgccaaagctatttaccagcgctgctggcattagccgtcagcgcttttgcgatcggcacaaccgaatttatcagcgtcggactgctgccgcttatatctcaagatctgcatatacctgtgacaacggcgggacttaccgtttccatgtatgctctgggcgtgacattcggcgcgccggttttaacgtctctcacatccggcatgtcgcggaaaacactgctgctctgggtgatgttgatttttatcgccggaaatacactcgcagcgagcgcttcctcaatcggcgtcttactggcggcacgggtcatttcggctttttcccacggcattttcatgtcaatcggggcaacgatcgccgccaatatcgtgccggagcataaaagagcaagcgcgatttccattatgttcacggggctgacggtggctacggtgaccggcgttccgttcggcacctatctcggccagcaattcggatggagaatcgcatttgccgtgattgtggcggtaggaatcatcgcattcctcacaaacgcgcttctcgttccgtctcatttgcgcaaagggacgaaaaccgcattttccgagcaggtcaaactcgtcacaaacggccggttattgcttttatttattattacagcgttaggctacggcggaacgtttgtcgtgtttacgtatttatctccgcttcttcaggaggtaacgggttttcagaaagaaaccgtcgcggccatcctgctcatttacggaattgcgattgccatcggaaacatgattggcggccgtttatcaaaccggaatccgctgaaagccttgttttatatgttcattgtccaggcagctgtgctgtttgtcctgacttttaccgcgccgtttaaaacagccgggctgatcaccattattttcatggggctgttggcgtttatgaatgtgccggggcttcaggtatatgtcgtgatgctgagtgaacgttttgcgccaagcgccgttgatacagcatcagccttaaatatcgcggcatttaatgccggaatcgcgatcggctcgtttgccggcggaatcattacagactcaatcggaatcattcataccgcttggatcggggcgctgatggtgctcagcgcggtcgtattaaccggatggagcaggaagctggaaaagcgggatcgcactgcccttgaaaggaggtgagtttttcttcagcgcattttgatttttttcgacagacaaataataggaggaatatatacatgacaacacatttacaagcaaaagcaacattgcataacggagtagagatgccttggttcggcatcggagttttcaaagtagaggaaggcgcggaactcgtcaacgcggtgaaaacggcattggtgcacggctatcgcagcgttgataccgccgcgatttacggaaatgaagaaggtgtcggcgaagggatccgccaagggctgcaagaagcgggattaaaacgtgaagacatttttgtcacgtcaaaagtatggaatgccgatttaggatatgaagaaacgttaaaagcgtttgacacaagcttagaaaaactcggtttagattatttagatttatatttgatccattggcctgtcgaaggaaagtacatcgatgcgtggcgggcgctcgaaaccctctaccgggatggacgcattaaggcgatcggggtcagcaatttccaaattcaccacctgaaacatctcatgaaagaaacggaaatcaagccgatgatcaaccaggtggagtaccacccgcgcctgacacagaaagaactgcttgctttctgcactgaacaaggcattcagcttgaagcgtggtcgccattgatgcaagggcagctgcttgatcaccccgtattacaggagattgctgagaaatacggcaaatcagccgctcaagtgattttgcgctgggatttgcaaaacggtgtcatcaccattccgaaatcaactaaaaaacaccgtattgaagaaaatgcaaatgtctttgatttcgaactgtcagctgaagatatgaagcggattgatgatctgaacgaaaatctccgtgtcggtccggaccctgacaattttgatttttaaccagaaaaacaccgttcggctttccgaacggtgtttgtttatgcccagccgctcaatacttcctcaagctggtgctttgtatattcaagactgccgctgttatcaatgacggcgtcagctttttttgctttgtccgctaaaggcatttgcgacgttatccggctcatcgcttcttcttctgtcagggaattccgctccatcagccgtttgagctgaatgtctgccggtacggtgacgacgagcactttgccgacaagataatcaagcccgctttcatacaaaagcggtatatccaaaacgacgaactgctcttttctcgcaatggcttcatcccgctgtttcagcatttccgcacgcactgccggatgaacgatctgattcagcttcagacgcttctgttcgtcagtgaaaacgatagaaccgagtttttttctgtcaatatcgccattttccagcaggatgtcttttccgaatgcttccacaatttgtccgtaagccggcattcctttttccaccgcctgtttcgcgatgacatccgcatcaatgactgttatttttttgtcgatcagcatacgcgctaccgtgcttttgccgcttgcgatgcctcccgttaaaccgatgaccaagctcaaaaagcccactccttcttacattttccaaatcccgatgataatcagcaggactcccggcaaaaatgtcattttatctatccaattccaccttgaaagcaaatgccccgcgtttatgccgagtgaaacaaacagcgagctcatcaccccgacagtcacgctcatcataaccggagaaaagccgagaatggccgctcccagcccggcgccaaacgcgtcaatggataaggcgataccgagcagaagcgcctcgactccgttaatggttccggattgatcaatatcggcgctggtcggttttttcaaaatatgaatgacgatgccgagcgatttcacttcaagattaagcagcgttttttcatgcaataagtaatccggctctttagccggtttaaaaaattgccagatgacccatgcccctattccgattaagatcagcccgcccagtttctccgtgacggatacaggaaaaatctttgtcagaaaatggccgatcagcatggatataaacatcacagaggctgaacagcaggcgatcacggcaatcgctttgaacgggattttcatttttctcaaaccgtacgtaaacccgactgaaaaactgtccaagctgacagcaaaagccaaaagcagcaaagaaacaatctccatatccgtttctccctttctcttgatcggcaattgtgacatatgcctattgggtgaatcacaatatatatatggagaaaggtcatcaactgtgttagaaaaaagtcattctgctgccgcctgcttgaacagcttcagtttatgattttttttggcagcgggcgcaaaaatgagtgcccctcccgccgaccacgattttagaaatcatcgtgccgcacgttttgcacggttcatcctttttgccgtagacgtaatgtttgagctgaaacattccgatctccccttgagaattgatataagaccggacggtgctcccgcccgcgtcaatcgcttcctgaagggtgtctttaatttctgtatgaagcgtttttatctgcccgtccgacagactgttcgcttttgtttcaggatgaatacgcgcccggaataaagcttcatcgacataaatattgccgaggccgacgaccgctttttggtcgagcagggcggtttttaccgcgcggttcgtttttgcaagccgctcttttaaataagcggcggtaaatgcttcatcatcgggttcgggcccgagctgtgaaagcggtaatgcattccgttcctctcccggcgcaaacaaatgcatcgtgccgaatttccggacatcccggtagcggagctgtgttccgtccgtcatgtgaaacacgacgtgcacatgtttatcgtcaggctcatcggcctgatgaagaccgtatttcccctccatacgcaggtgtgacaccatgacataatgatccaaatggaaaagcaaaaactttccccttcttccgatggatcggatcgtttctcctgcaatctgccgcgcgaattcctccggctcggcgggttttttgatgatattcggccatctgatatccgccgattcaatcgttttccccttcacaagaccggtcagagtgcgccggaccgtttcaacttctggtaattccggcacaatcatcacttcctttttttctgtttattttgcatcgtaccaagacggccctgaagcataatccgccttcagcggcacgtctaatgccaaagcatgctccatcacttcaggaaccagcttctctaatatttcaatttcttccttaggcgcttcaaaaattaattcatcgtgcacctgaagcaacagtcgcgccttcaggtttttttctttcagctcagctgccatgtcaatcatggcttttttaataatatcggcggcgcttccctgaatcggcgtattcatggccgtccgttccgcaaagctccgcaggttgaagttgcggctggtcagctcagggatatagcggcggcgctgcataagtgtcgtcacatatcctttttgtttcgcttcctgcaccgattcttccatatacgccttgacgcccgggaagctctccaaatagcggtcaataaaagcgcccgcttctttccgggtgatgccgaggttttgcgacagcccgtaatcactgatgccgtaaacgatgccgaaattgacggcctttgcctggcggcgcatcgcttgtgtcacttcatcttcactgacatgaaacacgtccatggcggtttttgtgtgaatgtccatatcattcgtaaacgcttcgatcagattttcatcttttgaaatatgcgcaagcacccttaattcaatttgtgaataatcggcggcgaaaataagccagtccggttcggacggtacgaaagcctgacggattttccgcccttcctccagccggatcggaatattctgcaggttcggatccgttgagctgaggcgtccggtttgagtcaatgcctgattgaatcgtgtatgcaccttatgagaacccttgcgcgtgactttcagcagcccttcaatataagtcgattggagtttgccgatttgtctgtattgcagaatgtacgcgacgatatcatgtttgtctgcgagcttctcaagcacatcagctgaagtggaatagcctgtttttgttttctttactggcggcaggccgagtttttcaaacagaatgacgccgagctgttttggtgaattgatgttaaacggctcaccggcgatgtcatggattttttcttcatattctttcagttttgccttgagctcttctcccattcgcttcagtctttccacatccactttgacgcccattgattccatttctccgagaattagcgcaagcgggagttcaagatcttcataaagctcaagctgattattttcttccaaagcgtcaagcagtttgtcacggaggctgttaacggcagacgctttccgcgcgagatgatcggcaagctctttttcagcgggaacggcgcgttttgcgccttttccgtataccgcttcatcttttgaaacgatattcagcccgtattctttcgctacgctcgcgacatcgtcgtacgaattgcccgggtttataatgtaggcagcaagaagcgcgtcaaattccgttcccttcagctcaattccctgccagcgcaaagcgacgacggaacgtttgctgtcgaacacccactttttcatcgattcatcttcagcccaagatttaaaagcttcagactgaatggcgatttctttcggaatataataaagacctgtttcattcacgatggaaaagccgaggatcggttcttcgtgatagttatcaccgatttgttcgacgaccaaagcggacggcgaaacgagcatatcttcggtgatttcttctgctgtttcgacattgatgtcttcaaaattttcttccgccgtttccccgctttcttcaccgagccgctcaagaagcgtattaaaaccgaggtctttaaaaatggcaacaacttgttcacggtcaaacccttggtaatctaaatcttcgggcttgacttcaatcggcgcatttgtcataatcgtcgccagctctttgctcatcagggcttgttccttatattcttcaagcttttcttttaatttttttccgctgacttcatcaatggaatcaagcagtttctcaaccgaatggaactgctttaagagcttaatcgcggttttttctccgacgccggggacgcccggtatgttatcggatgaatctcccattaatcccttcatatcaatgatttgcaaaggagtcagaccgtacttttcccgcacgtgctccggcgtgtaatcttctacgtcggtaatgccttttctcgtaatggcaacggtcgttttcccggttgcaagctgggttaagtccttgtcccccgaaacgaccttcacttcaaagccgtctttttcagcagatacggcaagcgtgccgataatatcgtccgcttcatattcaggaagctcgtagcggctgatgttgtaggcatcgaggagctcgcggatgaacggcatctgttctgaaagctccggcggcgttttttgtcttccgcctttatattctttaaacgtgctgtggcggaaagtggtttttcccgcatcaaaagccaccagcatatgggtcggtttttcatcttccagcattttcattaaaatcatcgcaaacccgtatacggcatttgtatgaatgcctttttcattgcttaaaagcggcaatgcaaaaaacgcccggtacgccagactgtttccgtcgacaagcactaatttttttcgttccgtcattcaatatcctcctaagagcaaaagctcgtcattcctctgttttttaatctcacagcttctcttattttaacaaagttcaatttgaaaggaaaatgagcggaccccgtgaaaacgcaaaaaaggacgggaacaagaaaacgcgttcccgccgtcaaaattggctccttggatgaaggggttctgttatatcctaacaagataggtttaacaggtcatgaagaaattgttaatcctttgtaaagctgatcacgctgccggcggccgcttcagcgtcacagtgaacacagttccctgtccaggctcgcttgtgacctcgattttaccttcatgggcttctattaagtgcttcacaatggcgaggccgaggccggttcctcccgagttgcggcttctgtctttatccacgcggtagaatctctcaaatatccgcgggatctcttctttctgaatgccgattcccgtatcggacactttgatatcgacaacggtttctttcacatgtaccgaaatccccaccgtccctttttcaggcgtgtaggtcagggcattgttcgccagattcaaaaatacctgcttcagcctgtgcgcatcacccgtcacaaaaatcggctcttccgggagatcgagctgaaagctgatgcctttttcctcagccttatgctgcaaaagcgcctcaatttcatgcagaatttttgcagcatcaaaggactctacgcgcatcgtaaagttttgctgctccatcttggataaatccaataaatcctgcacgagagattggagccgctcactttctttcagaatgatagacagaaagtctgaaagcgccttttcgtctttcatcgctccgtctaacagtgtttccgtaaatcctttaatcgaggtgatcggtgttttcagttcatgggagacattggcgacgaagtcctttctcatctgctccaattttttaatttccgtcatatcgtgaaaaacgaggacgatgcccttccattcatcatcagggcccatgatcggaacgccgtcaacttcaaagtagcgccgctcaatgttgatgggaagtctgagcagctggcattttttcgtctccgtcataaaaatgtcttcgacaagccgaatgatctcctcatgttcaaacgcatcgtggtaaaggcgccgaagcagacgttcaggctttgtatgaaactgcttcgtgtatgaccggttcacgagattgataaaacctctcccgtctattaaaatcaaaccggatccgatattttcaatgacggttaacagacgatcgcgctgcatatcctgcgttcttgtcatttccattaaatcgaccgccaggctgttcatcgcacgcccgagacggtccgaccgccttgcgtaaccgctgtaggagcgggcgtcgtaattccctttggacagctccgtcgccacctttgtcgcggcgtcgattgattttttgtaacgcgacgtcatgtttgtataaaagaaaacgataatgataaaagcggtacaaagacttgctgccagcatgccccacatttctccggtaacgcttgaaccgccgttgatatccgaggaaacgagtacataccccgcaattttccctgcgtcattttttacggcagtgccgcggatgactctgcttttcgactgtacggcttcctcgcttttattgtgagaaatgaactcctttacggctgaatcatcagcacgactgccggaatgatatacggcgtcacccttctcgttgagcaaggagacgtttataccgagggtgcggccggcgtcacggattaccgtttcattgcttttattgccgattcggccggtgtcaagaaggcccgctatgtataccgattcctttttcagctgatccgccgttctttcttcagcggatgaagaaataagctgctgtaaaaaaaggccgagaacactgaaaaccaatatgatacatacaacgagtaaagcgaacagacgcacacggactttattcattcatttttggctcctccagtttataccccaaacctctgattgttttaatatagatgggttttttggtatttgattcgattttgtcgcgcagatggctgatatgaacgtcaacaatccgggtatccccggcaaaatcatagttccagaccgcgctcagcagaagatctctcgtcagcactcttcccttgtgttttcccaaatacagaagcagttcaaattctttaggcgtcaattccagctgttctgacttgaagtacgcttcgtaatgctccggaagaattttcagctcgccgatgaggatctgcccgtccttttcctcttctctgccttgtgacagcgaagaaatgtcagcccttcttaaaatggctttcacccgcgcagtgacttcccgcggactgaacggctttgtcatgtaatcatccgctccgagctccagtcccagcaccttatcaaattcctcatcttttgctgtcagcatcaagatcggaaccatcattttctgctgtctgagctgtttacagacgtcgattccgtccactttcggcagcatgacatccagtacgattaaatccggattttcattctctgccagctccagagcctcttcgccgtctgatgcggttatgacatcatagccggaccgttccagattatactgtaaaagagtaacgatagattgttcatcatctacaactaaaatttttttgttcatgctgcgccctccgctgtctattttccccgacatccaattttctctattttatgtgctgcatatcactttatgatttcattttatccaatactgcccgttcagacaattcgcctttttgatcattttcagagaaaggatcgctcagggaaaaagaaaacgctttcattaattgtaaaaagaggaaggcttctgattcggaagccttcccttttttcttatgacaatactttcatcacgtttttgacagattcaactgatttactcagctgcgctttttcatagtctgtcagttcaagctcgatgatttgctccaggccgtttcctccgataatcgtcggtacgcctaagtaaatgccttcatgaccgtattcgccttctaagtaagcgatggtcggaagcacgcggcgctgatctttcaaaatggcttctaccatttcagtcagtgatgcagcaggcgcgtagtaggcgcttccgtttccgagaaggttgacgatttccccgccgccttttcttgtgcgttctacaatcgcatcaagacggtctttcgggataagcgtttcaagcggaatgccgcccgcataggaataacggacgagaggaaccatgtcgtcaccgtgtccgccaagaacaaaaccggtcacatcttttacagacaggtttaattcttcagcgacgaatgttctgaatcgcgcagtgtcaagcactccggattgtccgatgacgcgttctttcgggaagcctgattctttgtacaccgcatatgtcatcgcatcaacagggtttgtcaatacaacgataatgcagtcaggagaatatttcacgatctcacgtgtgacgcttctcatgattttttcgtttgtagatacgagatcatcacggctcatgcctggttttctcgcaattccggctgtgatgacgacgatatcagaaccggctgtgtcctcgtagttggacgtgcctgtgattttcgcgtcaaatccttgaaccggacttgcttcgagcatgtctagcgcttttccttttgtcgggttttctaattgcggaatatcaacgagcacaacgtccgcaagctctttttgagctgtaagaaaggctgttgtcgctcccgtaaatcctgctccgataacagaaactttactgcgtgtttttcccatgattctcttctccttttttggcttcattagaagtctgctttaggttcagtccatgtttttgatgagctcttcaccgaactctgaacatttcacttcagttgcaccgtccattaatctagcaaaatcgtacgttactacttttgaagcaatcgttttttccatagatttaatgatcaagtcagcagcctcattccagttcaggtgttcaagaagaagcactcctgaaaggatgacggatgacgggttgaccttgtcaaggccggcatatttaggagccgttccgtgagtcgcttcgaaaatcgcatgccctgtttcatagttgatgttcgctcccggcgcgattccgattccgcctacctgagcggcaagcgcatcagagatatagtctccgtttaagttcattgtcgccacgacgtcgaattcgctcggacgggtcaagatctgctgaaggaaaatatcagcgatgctgtctttgacgatgatttttcctgccgcttccgcttcgctctgcgctttatcagccgcttcttttccgtctttttcgacaatgcggtcatattcagcccaagtgaatactttatctccgtattctctttcggcaagctcgtagccccagtttttaaatgccccttcagtgaacttcataatgtttcctttgtggacaagcgtgacagacttacggccgttttcgatcgcatactcaatggcagctctgactaagcggcttgtgccttcttcagaaacaggcttgatcccgattcctgacgtttcagggaaacggattttgttaacgcccatttcattttgcaggaagctgatcagcttttcaacttcttcagaacctttcgcatactcaattccggcgtaaatatcttccgtattctcgcggaaaatgaccatatccgtatcttcaggacgtttgaccggagaaggcactcccgtgaaatatctgacagggcgcaggcacgtaaacaaatcaagctcctgtctcagcgccacgttcagagaacggataccgccgccgaccggcgtcgtcagaggacctttgatggcgatgaagtactctctgatgtcttccagtgtttcggcaggaagccactcacctgttttattataagccttttcaccggcataaacttctttccacgtgatttttttctcgcctttatatgctttttcaacagcggcttccaatactttagaagcggcattccaaatatcagggcctgtgccgtcgccttcaataaacgggataatcggattatttggtacgtttaatactccattagagactgtaattttttcaccttgtgacacaatattacctcccagtatgtaattcatatttagaaaacattttatttttcttgtataaaaaataaaatgacttttctcaagattctatcaaaattgtaaaccaatccgggcttgattaacaagaggctaacgacatgaaaatcaccagcctcccgtttgatcaggctctttcatcaagcggaacaaaagtctgcttatccggacccgtgtaatcagcgcgcgggcggatgaggcggttgttatcgtattgttcaagaatatgggcgatccatcctgacattctgctgaccgcaaagatcggcgtgaacagatcgtgatcaatgccgagactgtggtagacagatgcggaatagaaatcaacgttaggcggaagttttttctccgacgtcacgatttcttcgacacggattgacatctcgtaccatttgctttcacccgtcagattcgtcaggcgtttgctcatttcttttaagtgtttggcgcgcgggtctccatgcttatacacacggtgtccgaagcccattactttttcctttttctccattttgctgcggatataaggctcggcgttttccacttcgccgatttctgtcagcattttcatgacggcttcattggctccgccgtgaagcggtccttttaaagcgccgattgcggcagtgatgcctgagtaaatatcagataaggtggcgacacatactctcgccgtaaatgttgatgcattcagctcatgatccgcatgaagaatgagcgctttgttaaacgcttccacttcgatcggagaaggctcttcaccgtttaaggtgtaaaggaagttctccgcgattccgtactcttccttcggttcaacaggatcaagtcctttgcggattcttgagaaagcggcgacaatgcccggcactttcgcctgcagacggatggcttttctgtagttcgcttccggattcatgacatcggcttcactgtcagtcagaccgagtaatgaaatcgccgtccggagcgcagccattggatgtacgttattgaggggataggatttgaagtgctcaatgatttcttgtggaacggcagcttctttcgcaagctgttttttcagttcagcaagttccgttttattcggcaggcgcagatgccacagcaaataaatgatttcttcaaaacttgcattctctgtcaagtcgtcaatatcgtaccctacatatgtaagggtatcgtcgataatagagcttacagatgatgttgttgctacaaccccttcaagaccgcgtgttgctgtcatattcaacctctccttttcaatcaaaattcccctttaaagagtatataaaacatacggcttacttaaaatgagtcatgcaaacaatccctttcccctttaagaaaatgcttacatttcactggttgcggttacataaccggtatgcttatagaggaacataacaaattcttataagcttatttaagtttaagcctattcttattataaacaataatctgattaatttgtagacttttaactaaaaatgttttaaaagccctatatatcaaggcttggcgttgataaatttaatcgcttgctttcagatgctttgtaaaaccatgtattctcatgttttcatttggggggagctttggggaaactttaaaaggacaggcgcaacaacttcaccgcaaatccctccttctttaccggagaaggggggattttgtttactcgactgaatcaatgttcggatcagcttcggaaatccatgtcttggttttagttggctccccgtacatggactggaatcgtttgactgcatttgcgctgttgtcggcccgtaaatatcctcatcaaaccgttcatcaattgaaactgactcatttactgatgtaggtgaagttaaataaatgcagaaaaaccctcctcatctcgagaagggctcgatttctgcttcttttttctaaatcagtccgaagaaaaaactgatgccgctcaactttttaatcgaagggcttcgggttctccaactatttgcccctatgcttttcttttgctttttgttttctgattaaatatttttgttcctttattttttctctttgttttctgttcagttgttttttcttttcttttcttgcttcaagctcctgttttatcgctttttgcgccttagttgatatcccgatatttttcatctctttagaagcttgccgttgtaatctttttgggtttaacttcttagattttgctttaacacaaacccctgtttgttcagtgcgggagagagtctgtaaaagttgattatgaacaaaatgcatgatttctgaatccttgggctcttttccaaacaaatgacgaactgctcttaatttcccatcattcacaacttcaatgactcctacccaaaactgaccatcgtagtaaaccgttaatttcataacgattccctcctcctaaatttactgaagaatgatggacatcccgaggaggggaaggttactgacattttaaataatgcatccggactaccaaccgaattgtgttttttcattctcattataaatttaacaaactttcaaattgaaggaaagggtctccgcttattttaacaacacttcaagttttgatttggttcaagtgcataaattccatcagcttttaatccattcatcaattggaaccgccttactgcatccgctgtcatcgcacaatatgcgccggcgattccgaagttctttgttacatggtaagccacttcattcctcggaataatgcaaatggcatttgtctgaactacaaaatgccctgcaaactcttattttcacccgcaaaaaaaagcagctttacgccgcttttttactttatgaagtgaatattttaacgatttgcatggccaagtaggcgattccggcgccgattaacgggccgacggcgacgcctccgaaaagcgcgacggcaagtatcgtgccgatgaccagcgccgttgtaatatgagggtcgttttccaataaggtgagaccgtttttggcgattaaggcaaccgcgatcccggcaccgagagcgatccacgcataatatgatttcatcgcttctccgagctgtttaaaaccgatatcacctgtggcaatcggcactaaaacggcgattgtaatgacggtgacccccagttgatgccttttgactgaataaccggaaatagtttctgatcaagaccgacagcttttatcacaatgagaaagccgacggcaaaaagcaatgactgatttttggctaccaatgcgatggccagcaataatagtaaaaataaattcgcctgtgtaaacatcctgaaagcaccctctttcatcatatctgtaatcatatccttttttttgacgaataaactaatgtaataggacgtgccgaccgagaggaggatcgatgtgaatccgcactatgcaactgtttttttccgcgcgctgtttgtactcgctgcggccggcggcgctttagcggccggttacgcctcatttccgttaacttatccgtttctgatcgcccttattctgtcatcagcgatcattcccgttgttgactggctggacaaactgacggggctgccccggtcagtcaatacagtcattgtcctggtcttctttttgcttattcttctcggcgcggcaacatttctcgttgcggaaatcatttcgggaaccgcctatctggccaaaacgctccctccccatatcagcgcctttatgacgtattgcgaagagctgttcacttcccgcattcagccattgtaccacgagctgaccgtcctatttaacgggctggaaaccaatcagcaggcttccatcgtgacgcatattcagaccctcggtgatacagccgctaaaaatgcggggctcatgctttcacatcttttggagctggtgccgaaatggattgccttccttcccaatacagctgccgtcttcattttcgcaatgctggcgactttttttatgacaaaggactggcataagctgaaggcgctgctttattccatttttccggaacgggtttcggcaaacgccaaggccgtatcgggagagctgaaaaaagcgatggcaggtttcattaaggcgcaggccgtgctcatacttttcacgatgatcattgtctttatcggactttttcttttagggattgagcatgcggcaaccatcgccttttttatcggcctggttgatctgctcccgtatctcggcgccgggtcggtctttgttccctggattatgtatttggccattgccggtcagcttcctcaagcgatcggtctcggtgttttatatattgtggttctcattcagcgccagctgacggagccgaaaattttaagcaagtcaatcggacttgatccgcttgcgaccttaatcgccctgtttgccggctttaaattgttcggaattttaggactggctgccgggcccgcgctgctcgttttcattcaggcctttatcacaacgggcgctctaaaagaaatatgggcctatattactgttcaatccaaataaaaacagcagccctgtaagaaggctgccgttttttatttgataatgatccgcttgttttttgacatccctctcagccatttgaacaaaaacggcttcatgcggttccgagtgaacggaatcagaagacaggcccctgcaatatcggacagaaaacccggaagcatcaaaagcaggcctccgaaaaagacgcatattccgtcaagaagcgcttcccccggcattttgccgtgctgcaggtcgcgcatcacccgatgatacacatcggttccctgtctttttgccaccaaagcgcctaacacgcctgtcaaaatgatgagaaggaaggtcggaaaaataccgagccattttcccgccagcagaaacaaaccgatttcaattgccggacatacgataaacagtaagaataacactctcatttttctgccctcctgcccttctaaaagcgcgtcaccgcccgcatgggaataggaaaatcaacctaaagacaaaagagaagggagaacccccctctcttttttaaagctgtttaaagaacgcttgcgcggccttcatacacagcgccgcgggcagcgtcaactgtgataacctgtccttctgttaaaactgaagttgcgttctcaaggccgacgataaccggaatgcccaagcttaaaccgacaacggctgcatggcttgtcagaccgccttcttcagtgatgagcgctgatgctttttcaagtgaagcgatcatgtcgcggtcagtgcttgaagcaaccaatactgcgccgtctgtcattttttgttcagcttctttcgcattttttgcaacaacgaccggaccgaatgcagatttgcgtccgatgccttgccctttcgcgataatgctgccgacagtgtggactttcatcagattcgtcgtgcctgattcaccgacagaacctgctgtaatgacaatcagatcaccgcgtttcacgatgccgctgtcaagtgatttttgaaccgcgtcttcaagcatttcatctgtagaattcgcgttttggccgcttgacgggaatacaccgaatacaaggccgagtttgcgtgatacagactcattaaccgtaacggctacaatcggagcctgcggacggtatttcgcgatcatacgcgccgtatggccgctttctgtaggcgtcacgatagctgccgcactcagattgatcgccgtgtgcgcaactgattggccgatcgcatcagtaatcgtcatgccgacctgatctctgcgtttagacagaatttctttatagttcagagattcttccgtgcgtgtggcgatgttaaacattgtttgaaccgcctcaacaggatattgtcccgcagccgtctcaccggaaagcatgatcgcatctgtgccgtcgaaaatggcgttggcaacgtcacttgcttcagcacgtgtcggacgagggttgcgctgcatgctgtctagcatttgtgtcgcagtaataaccggtttgcccagcgcgttgcattttttgatcatttctttttgcacgagcggcacttcttcggccggaatctctacgccgaggtctccgcgcgctaccattaggccgtcagatacttccaggatcgcatccaggttgtccacgccttcctggttctcgatcttaggaatgatttgaatgtcagacgcgttatgctcttcaagcagttcgcggatttccaggacatccgtagaacggcgtacaaatgacgcagcgatgaaatcaacgccttgctcgataccgaatatgatgtctttggcgtctttttcagtaattccgggaaggttgacgctgacgccgggaacgtttacgccttttttatttttcagcgtgccgctgtttaagatttttgttttgatttcgtgtttttccggatttgattccagcacttccaatccgattaaaccgtcatccagcaggatgatagaccctgctgacacgtcgtctgccaggccttcataagaaactgagaatttttcaagcgttcccagcacctgtttcgtagaaacgataatttcatttcccgcctgaagctcaagcgcgccgttttccatatcgtgcgtgcggatttccggacctttcgtatcgaggagaatccccacgtttttgccgagctttttgctggcttctctgatgtttttgattcttgcgccgtgctcttcgaaatcaccgtgtgaaaaattcagacgagcaacgttcatacccgcttccatcaattttgtcagcatttctacactttcactggccggaccgattgtacaaacgatttttgtttttttcaactcgttcacttccttctgaaatcttcagcttcttccgccttaaatagacagttcttttgaaagctgatacatgtttggttcaacagtatgttttgattctaaaatttctataatatcatggtctacaagcttgttgttttgtatacctacgcagcgtccgccttttcctttaagcagaagctcaaccgcgtaagcgccgaggcggcttgcaagaacccggtcagaagcgcttggagatccgccgcgctggatgtgccctaaaacggatacccgtgtttcaaggttcgtttcttcttcgatgcgttttccgaattcaaccccgctgcctaccccttctgcaacgatgatgatactgtgttttttgccgcggtcgtgccctctcttcaaacggccgataatttcctccatatcgtagtccgcttcaggaattaagattgattccgctccgcctgcaagacctgcccataaagcaatgtcgcccgcatggcgccccatcacttcaataacgtatgtacgctcatgagacgtagcggtgtcacggattttatcaatcgcatcaattacggtgtttaacgccgtatcaaatccgatcgtaaaatcagttcccgggatgtcattatctatcgtacccggtacacctacacacggaaacccgtgttccgttaattttttcgcacccatgtatgaaccgtctccgccgatgacgacaagaccttcaatgccgagtttctttaaattttcgattcctttttcacggccttcaactgttttgaattcaggacatctggccgtatacagctttgttccgccgcggtggatgatgtcaccgaccgaacccagctccagtttttctatttttccgctgattaatcctgaataaccgttataaattccgtacacttcgacgtcgtggtagatagctttccgcacaaccgcgcgcaccgcagcgttcatacccggggaatccccgccgctcgttaaaactcctatacgcttcatttcctattcacctcagcaactatatatgttaaacatatcatgatcattgccctaaaacaatgaaaagggacgcctgagctcccatgaaaccttacctattatacaattaaataaattgtttttaaataaaatttaaggaatatcacaaaaatcacaaaaaataaacgtgagccataggcttcacgtctattcagtttaccccgatatattgatcctcaaccgaaactttcccgattgctttatatttttcatagcgctgtgagatcaactcttcggcgttcaatcgaagaagagattttaacgtttctttaagaataccgtcaatgtagcccgcctgctgcttgatatcatggtgagctccgcccttcacttctttaatcatatcatcaataattcctaattctaataaatcgggcgcagtaatcttcatggtttcggccgcttttttcgcaaggctggagtctttccacaaaatggacgcggctccttcaggagaaataacggaatacgtcgagttctcaagcatcagcatgcggttgcccacacctaacgcaagcgcgcctccgctgccgccttccccgatgacgatacaaacgacaggcactgtcaggccggccatctcgaacaggttcttggcgatggcttcactttgtccccgttcctccgccgctttacccgggtacgctcctttcgtgtcgatgaagcagataatcgggcggttgaacttatccgcctgcttcatgagacgaagcgctttgcggtagccctcagggtgaggcatcccgaaattgcggacaaggttttctttcgtgtcttttccgcgctgatgtccgatgacggtgaccggcatgccgtgatatttggcgactccgccgacaatcgcagcatcatctccgtatgttctgtctccgtgacactcaaaaaagtcggtaaacaggtattgaatgtaatcaagcgtcgtcggccggtcgggaaggcgtgcgatctgcactctgtcccacggcttcagatttttataaatctcatcctggagcttgctgagccggtcttcaagccttgcgatttcagcgcttaaatccatctccgaatcttgggtgaattttttcagttcggcaattttcgtctgcagttcaatcaccggtttttcaaattctaatcttgcagccactcatgctcacctcctgtttggtgcatgtccagcagaaatgcgagtttctctttcatgtcgtttcggtgaatcaccgcatcaagctggccgtgctttaataaaaattccgccgtctggaaatcttccggcagtttttccccgatcgtctgttcaataatacgtcttcctgcaaatccgatcaaggcgcccggttcagcgaaattataatcaccgagagacgcgaaactggccgatacgccgcctgtcgtcgggtgggtcatgacagaaataatcagtccctgctcctcactgaacagttttaatgcagagcttgtctttgccatttgcataagacttaagaccccttcctgcatacgtgcgccgccggaagcggtaaagatgataaacgggactttttcctcttttgctttttcaattgcaagcgtgattttttcgccgacaaccgaacccatgctgcccattcggaatgttgaatccatgatcgcgatcacggcagggaatccgctgatggttccttttccggtaaccaccgcttcattcagcgatgttttctcacggtctttttcgattttttctaagtattccgggaaaccgagcgggttttcagatatcattccctggttgaattcttcgaatgaatcttcatccaggaggctttcaatgcgctgctttgcattcatcgggaaatggtgcccgcagttcatgcagacgcgcaggtttttatctaactcttttgtgagcatgatttttttacatttggggcactttgtcataatgccttccggaacatcatgttttgcctgctcagacggcacggaagcatattttttcttttttgtgaatatatcctttaacaaatgattacctcccttttgtgaagggttctcttcactgcatgtcttccgattagatagacttaataataactttaccgaaactattgtactttttttgtcaaacggtgtcatcctccattcgacattttttgctgcaaaacagacggaaacggacggatttcataccgtaaaaagcgttgttcagccttatctgtcagcgttttcaaaagaaataaggattctgctgaaatttttttaagacctgcccttaaaaaaatgccagcagtccgtatattgaacagcagcgcgttgttttttccaacgcgctgccatttcatttttgtgttattattccccgatgactgtgagctgtcttgttttttcagccacttcttcaggatcgaccgtaattctggcgacgcccgtttccatcgctgctttcgcaacagctttcgcaacggcaggagccacgcgtttgtcaaacggagccgggatgacataatcagcgcttaattcttcctctgaaacaagggaagcaatcgcttcaaccgcagcaattttcatttcttcgttgatgtgagtcgcgcgaacgtcaagcgccccgcggaaaattccagggaatgccagcacgttgttaacctggttcgggaaatcagaacggcctgttccgattacgctagcgccggctgcgcgcgcgtcttcaggcatgatttccggattcgggttggccattgcgaagataatcggatctttcgccatgctctccaccatttctttcgtcagcgcgccttcgactgatacgccgataaagacgtctgcatctttaatgacatcctgcagcgagccatcgttgcggtcttggtttgtaaacttggccacttcgtttttcaccgcgttcatgccggccggacgcccttcgtaaatcgctcctttagagtcgcacatcacgatgtcgcgtacgccgaaatggtaaagaagcttaatgatcgcgatgcctgccgctcccgctccgtttgccacaactttaatggatgacatggattttcctgataatttcagcgcgtttacaagtccggcaacggttacgatggcagtgccgtgctgatcatcgtggaaaaccggaatgtttgtttcttttttcaggcgctcttcgataatgaagcagttcggcgccgcaatatcttcaaggttgacacctccgaatgtcggttcaagcagcttcacagtgtcaatgattttgtccacatcgtttgtgtcaagcgcgatcgggaatgcatccacgcccgcgaaacttttaaacagcaccgctttcccttccatgaccggaagtgaagcttcaggcccgatattaccgagaccgagaacggctgatccgtctgttacgactgctaccatgttccccttcattgtataatcatatactttatttttatcgtcataaatctctttacaaggctcagctactccgggagagtaggcaaggcttaagtcgtccgcgtttctgacttctacctttgcttttgattccagctttccttgatttactttgtgtaaatgtaacgcttcttctcttaatgacattctaaacactccttttaagtactttgttacatattctgccgcatagactggtacaatcgctggaggtgaaaaatttcagaatctttaaataagatagcacaattgtttcaattgtataacaaaacgattattgttaccactattttaacacgacgttttcgcggcccagcagctcttttaaacggtataacgcctgatggtccgcctcaatatgaaaagtatccggcagcctgatcgtctgcttgtctttttcataatatagataaacgccggtttcccctttatgctccagtaaaatacgcttcatcttttccaaaaactcctgattgtgccggctgccttcgattttgatgtaaacagacggcgctctgtctgcctccgtctgttcaagaagagaggcggatgacatgatgaattgtgtcttctcctgacgctcttccatttttccggcggcgaataaaagcgcgccttcttttaacagcggagacagccttctatattggtcaggaaacacgacggcttccatttctcccgtttcatcgcttaatgtgagaaacgccatatgctgacctgtctttgtccgaatcgttttaatgcccgcgagcaaagcgccgattgacagctgtcccttcggcatctgccgcgctgctgtgatcgtttgcgccccccgttttttcaggagatccctgaaagcagacaaaggatggcttgagaaataaacaccgagagcttctttttcgaaccgaagcttgtccacgagcggaaattcctcagcctctacatattttggcttaatggaaaacgattcttccaaaaacaatcccatttggtcatcgtctgcacgaaaaagttcagcgtgctctaaagccacatcaacggaggccagcaaggcggcgcgattttgattgaattcgtccatggcgccagaaaatataagggcttcgatggttttccgattcacgctttttgcaggtacgcgaaagcagaaatcgaaaagatcctcgaacggtttatgtgttcttgctttataaatatctttcactgccgagacgcctacgtttttaacggcccgcaaactgtatctgacggctccgttttccggcgcaaacggaaaaccgcttttgtttattgacggcggaaggacttgaatcccgctccccttcgcttcatgcagatattgcgatattttgtcctcattgccgatgacgctcgtcaacagcccgcacataaaatatagcggataatgcgcctttaaataggcgagctgatagccgatcatgctgtatgcgacagcatggcttctgttgaatccgtagttagcgaattttacaatcagatcgtagacctcgtttgcagtgactacagaatactccttttttaagcacccttcaacaaaatggcttcgctctctgtccagaatgtccttttgctttttgctgacagcccgtctgagcagatccgcttcacctaatgaaaaccctgccatgcgcgaggcgatcatcattatctgttcttgatagacgatgacgccgtaagtgtcactgagaatatttcttacgtcctcgtgcggcacttccacacgcgcccgtccgtgcttccgatcgataaataacggaatattttccatcggtcccggcctgtaaagcgcgttaaccgcgacaatgtcttccagtcttgacggcttcaggcgcttcagcacgtttctcattcctgatgattccagctggaaaatacccgtcgtatcaccgtttgacaatagcgagaacgttttttcatcctgataagaaatctcggaaaaatcaattttcgtattcgtctctttttcaatcatcgttttaatggattcaataagcgtcaggttgcgcaaacctaaaaagtccattttcaaaagaccgagatcttccaggtgatccatcgcatactgcgttaaatacacgccgtcatgcccttcttgaagagggacaacttccgaaagcggctctttactgagaacgaccccggccgcgtgtgttgacgtgtgtctcggaagaccttcgattttccttgcgatctgaaacactttatgaagaacggcggattcggacagccgcctgttcagctgagcggactgccgcctcgcctcctcaagcgtcattcccggtttcgacgggatcaggcgggcaagctggtcggcttctttcgggctgattccgaacactctcccggtatcccttaacgccgcctttgcggccaatgtcccgaaggtgataatctgggcgacgtgcatggccccgtacttattttgtacatactgaatgacctcatcccttctcgtatcagggaaatcgatatcaatatccggcatgctgatccgctcgggattaagaaatctctcaaacagcagagaatgtttaagcggatccacgtcggtaatgaaaagcgagtaagcgacaagcgagcctgccgcggacccccttcccgggcctgtcacaatgcccttttcatgcgcgtacttcataaagtcccatacgatgagaaaataatcactgaatttcatgcgcctgatgacgtccagctcatattcaagccggcggacagcccgctcatcaggagtgccgaaacggagacgcagcccctcatgacagatctccgccaaatagtcatcggctgatttgccgtccggcgccggaaaagacggaagctgtgtctgtccgaggcttacatcgacccggcattgccgggcgatacgggcggccgcttcaatcgcttccggatgccgcgtgtaaagctctgccatttcttcaggcgtcctcaagtataagtccggcagattcccgctctgatcctcccatttctctccggctttaatagcgcacagacagcggtacgcatcttgatcttctttcttgatatagcggacatctcccgcagcgcagacagcgatttccgtctcggctgacaggcggagaatctcttctgataacgtctcatgtcctttaaacggctggtaccctaaataaaaacggccgtctccgaacagctcccggaatccttcggcagcccggaccgcttcttcaaacttcccggcttgaagcaggctttcaatgtacccgttttcaccgggcgtaatggcgatcagcccctcatgatagctcttcatccattttcgcttcatgccgccctttgccatggattgcagcgcacttgagattttcaccaggttctgataaccggtgtttgtctccgctaaaagaatgagcgggtgtgcttcaagctccgtatcgtccgtgtatatagaagccgtcagaccgataatcggcttaattccgtttgatttgcatgctttataaaactcaatggcgccgtacatcacattttcgtccgtcagcgccaatgatgaatatccgagttccttcgcttgtgtaacaagctcttttacagaagcggcgctgtttaacaggctgtagccgctatgtacttgcaggtgaacaaaagacaatgccgccactcctttcccatacgttcattttgtctttctacattataagacgggttttcttaagaaacaaatgttcttttttgactcatcatcatacttgtccgtttcgctcaatatgatagaaaagtgaggtggtgtatatatggatcaggaagccggctttatggcgaatttcatcagcagttattttatcgccctcggtgtgttgctcggcggcgcgctgatcggcggcctcggagcttatttatcaggcgagcctccgctgacggcgatcacaaaattggcgaacaggctgaagatctgggcgcttgtcgcggccatcgggggaacatttgacgcggtatacagtttcgagcgggggctgtttgaaggcaacacgcgcgacatcttcaaacagcttcttttaattatttcagcaatgggcggcgcgcagaccggctggctgattatttcatggctgacccaggagaatatgtcatcatgagaattcccgagtattataaaaaaccgggatggcagcgtttttttgcgggaatgatgtgcggagccatcatcagctggctgttctttctgtttacatacggaacgtttcaggaagaacaggtgacgttaattgaaaagcagcgggagcacgcgcgggatttaaaaaaccaaatctccatctatcagaaagatcttcataaattaaatgaggataataagcaaagacttctcatccaaagtgttgatgtgaagctgattaattgggaaaaatacagaatcgcccagcctgacaagatgaaatttgaggaacaggtgaaagataatatttctgaagtcatcacaaaggatattgaaagcgtgtataaaacaaaggagcttttaaaacggacaattgaaaacaaaatatacaccataaatgagaaggaatttaaagctgaagtaaaggaactgacgatttatacgagattgtctgtcgaaattcatatttcttttgcgacgtaattatgttatttttaaaaattttccatagatctgtcgcttttttctccgcttttttataaactgtagatgagacattttcaacgattctgaagggaggaagggaaaatggaggtttttagtgaacgccgcttggcaaaagatcatgcagcccgaatcagacaaggctattccgcatatgcagaaacagacacactcgcttccctcataaaaaaagaactccaaatctgtaatctccgcgtctacgaagacctgactgaattcggctgctggttcatccccgtgacagatgaacactaagaaagagggtctcccctctacttgtgttcgttacatacctcttccagatcagcaagaatctgatcggtttcatcccagctgaagatggatgcgccggccgcaagcggatgtccgccgccattgtatttccgggcaattccgttgatgaccggaccttttgaacggaaccggactctgatttgatcgtcttcttctacgaaaaacacccaagcgcggatacccgaaatatttccgagtgttccgacaagctgcgacgcttcagaagcggtggttccatatgtctccaaaatgtcttttttaatgaaaacggaagcgacgccgttttcagacagtgacacattttgataaataaagccgttaagcttcaccacatttaattttgtttcatacaattgattgaacagctctgacgatgaaaatgggaactcaatgagctctcccgcgtattttaatgtcttttttgtggtgttcgggaataagaagcgccccgtatcaccgacgataccagcgtagatcagctcagctgctttcgtattcagtttccagccgtgctgctttccttccaggtacagctcatagatcatttcgcttacggagcttgcattcgtatcgacccataacagatcgccatacggatcttcatttggatggtggtctattttcatgagctttgcgccggaatggtagcgctgatcgtcgaccctgccttggtttgcggtgtcgcacacgatgacaagagcatctttataggtttcgtcatccacctcatcgagggaatataaaaaagacaaggacggttcaggctgtccgacggcaaaaatatttttttcgggatacgtttcccgcaggatttctgtaaggccgcactgtgaaccgtaggcatccgggtcaggcctcacatgtctatgtaagataatggtgtcatataatgatatggttctgatcagttcggatttcatcgttttctccttttcgtttttattcatttaatcatactctttatccatggaaaaggaaaatctttcagcaacggtataaacggttttgcaaactcatataatggaggatttcatttatgctggtttttgtttttctcatcgggctttctgcctgcttttacgtgtattacaaagtaaaaggaatccagacgaaacgggcgctggagaaggaatgtttttcggctaaatcaagtatggcattaggcgcgctggtgcttttgtacggagtaaaccaaatgattctgttccactccgtcctgaccctggtcatcggcggcgtcttcattttaatcggagcaggcagcgcatgggccgggtataaagcctataagcattatgagcccatccatgcaaaggaagcggagagggaccacgcataatgaatgccaagggacccgggtgtgtcccttaacttctctccatcagctgcaccatgagcatcgcttttgaaacgatgccgctttggcttgacacttccacttccattttcccgaatttccggcccgcctctaaaatgcgcggtttcacttctatgaccgactccatctgtacgggcttcaggaagaaaatcgtaatgctttcaatgaccagctcgccgcgtttgcgggagcgtaaaaatcggctggcggcctgggttaaaatcgttgtaaacaccccgtaagaaatcgtgccgagctgattggtcatttgcggcgtgacttcatattgataaacggccggcgttttgttatcttcctcttctttaaatccccttgaaacaatatcatccagcttttccccgacctgaggctgcttttgaaccatttgaagcgcttttaagacatcctggcggctgatcattccgatcagtttgtgatgcccgtctgtcaccggaagcacttcaattccttcccaaaccatcatttgagccgctgaggcgacagatgtttttccgatcaccgtgacagggtttttggtcattactttttcaatgggaactgaccggtcatgccccgcgatatctttcggcgtgaggattccgtggattttcatctgctgatcgataaccggaaagcggccgtgtccggtttcatagttcttttcgtaccatttctccagtttatccttagggaacagcgtcactgtccgatctgcgggcgtcaaaatatcttccacgagcacaatctctttttttatgagctgatcatagatcgcccggttgatcatcgcggctaccgtaaaggtatcgtagctcgtggagagaatcggaagctcaagcatatcggccagctcgataatgctgtcgtcggtattaaaccctcctgttaccaaaacggccgcgcccgcttcaagcgcctggcggtgggcgttgattcggttcccgacgattaacaggttccccgccgccgtataacgcatcatcgcgtcaagctccatcgccccgatcacaaacttattcaacgttttatgcagacctgcttttccgccgagcacctggccgtcgatcacattgacgacctcagcgtatgtcagcttttcaatattttcttttttcttctgttcaatccggatggtccccacacgttcaatagtggaaacgaatcctttgttttcggcttccttaatggctctgtaagccgttccttcactgactttcatttctttcgcaattcttctgaccgaaattttttcaccgacaggaagcgaatctatgtatgataggatttgttcatgctttgttgccaagcgtttcacctctaaggacagtcttctgcttttattataagggtacgggggattcattcgcaatgagacgcccgaaaaaaggcggcaccacaaaaaagaccttctgaatgcttgattcagaaggtctttgacacatatgtcaggcaagctcaatggtctcgccgaccgccatgactttgccgacgcctccgggcagactttcagcgaaagcgtcagggtcctgttcaatgacggggaatgtattgtaatgaacgggaacgacctgtttcgctctcagccattcagccgcgagtttcgcatcttcaggccccatggtgaagttatcaccgatcggcagaaacgccaggtcaatgtgattcagttccccgatcagtttcatatctgagaacagcgccgtatcgccggcgtggaaaatcgttttgccgtcaatcgttaataaaatcccggccggcatcccggtgtatgtgatggttttgttttcttcatcagtgaccgccgatccgtggaacgcctgtgtcagttttactttgccgaaatcaaattggtgcgccccgccgatatgcatcgggtggacctttaaacctttaaagccgagataaacggccagctcgttcggcgcaatgacgagcgcatcgttttgtttggcgatctgctctgtatctccgacatggtcattgtgtccgtgagtaagcaggatgacatccgctttcacttcttccggtttcaaatttgtcagactgtttccggtcagaaacggatcaaaaataatgttatgggttttcgtttccacttgaatgacagaatgtccgtgataagtcactttcatcgttttcacctcataaaaaattaatatttatcaagttccctttttgacaaacgaaaaaacttacagggattgatgcctgttaatcacattcagcccgcctgttgcttcaatgaccgttccggttacaagatcggaatcttcttcacataaaaacgcgatgattctcgcaatatcctctccggttccggacctgccgatcggcgtcttttctttgccgattttccgtcttgcttcctctatagacgcttctttcatatctcctacaatatcacccgggcagaccatattggctgtaatgcctgattcggcttcttcaatcgcaatggttttcgttaacgaagccaatccgactttagccgctccgaaagcggaacggtgaagccagccgggggcatggtccgctccttgaaaaccgtatgtaataatccggccgaagcgctgctgtctcatgaccgggataaccgctttaaacagatggaaaacggcgcttaaattcccttcaagcatgccataccattcgtcatcggagtaatcggcaagctttttgcgctcaaatatgtacggcccggcattgttaatcagtatgtcaatccttccaaaccgctgaagggctgcatcggcgatccgcatgagatcttctttccgggttacatcgcccttaacgaattgcaatctgtcatggcacccgggataatccgccttcagacaagcgaccgcttcttcgtcctgtctgtaattcactgtgacagaaaagcctttttccagaagcatttcagtcacttttcggcccaatccctttgtaccggcagtgattagagcatgtcgcacattgaataccctccccaggcaacgtagccgcttcaataaaatcaagacgtttctccctctactttactataaacaaacggcaatatcacttttttgcacttcgtccgcacgaaaaaaaagccgtctttacagacagcttaattttctgaaggagcagaggcttcctccatgccgacataaccgctttggtatgcctctgagataagcctggccgtttcttcactttctttttcatcatagatgtaacggtcttgttctttgcgcattccttttacctcccatcttttatagatgtagggtgtctgatatgacgggaaaatatgaaggaaatttcagcaaattaaatgccggcgcaggcttttgcttttacgagcgcctgttctacctgctgaaaacccgttccgccggcgctcattcttttttcaaccgcatgatgcggatcgagcacggtatagatatcttcttcaaagagactgctggcttgaaggaattcttcaaatgccatgtcacttaaatagattcctttttcaatacagctgtacacaagcttgccgaccacttcatgcgcttctctgaacggcatgccttttttagctaaataatcggcaagttccgtcgcgtttgaaaaatcttgttttgtcgcttgtttcatgatgtctttgtttactttcatcgtttcaatcatgcccgtgaaaatctgaaggcttccttcaacggtttttactgtgtcaaacatgccttctttatcctcctgcaggtctttgttgtaagcgagcgggagtcctttcataattgtgaaaagacccatcatatcaccgtatacgcgtccggttttaccgcggatcagctccgccatgtcggggtttttcttctgcggcatcatgctgcttcccgtcgcgtacgtatcatccagttcaatgaatctgaattcctgcgagcaccatagaatgatttcttctgacaaacgtgaaaggtgcatcatcagcatgctgctgccgcttaaaaactcgagaataaaatctctgtcactgactccgtcaagactgttctcgtaaatggagtcaaaaccgagcagctccgccgaatagttacggtctatcggaaacgtagttccggcaagcgccccgcatccgagcggcgatatgttaatccgcttcatagcatcccgaaaacgctctttatcccgttcaagcatccaaaaataagcaagcagatggtgggcgaaagaaatcggctgggcccgctgcaaatgagtgtaccccggcagaatggtctcgacattggcctccgctttttcgatcagcgctttttggaactgttcaatcagcacgatgatatgcgagacatgatctttcaaatatagatgcatgtcagtcgccacctggtcgttccggcttcttccggtatggagtttgccgcctagcggtccgatttcttcaatcagcattttttcaatgttcaaatgaatatcttcataatcaacagagaattcaagcgctccttcctctgctttttgcaggagagtctgcagcccttgacggatggcaccttcttcttcttccgtcagaatgccgcattttttcagcattgccgcatgagcgagagaccctgtaatatcctctttgactaagttttggtcgaatgtgatggatgcgccgaactcatcgacccacttttccggtgttttttgaaaacggcctccccaaagcttcttcatgcttcaatctgctccttctttttcacaatgctgtttacttttgtcggcagcccccaaagctcaatgaaaccgattgccgcgtgatggtcaaacgcatcgtcttttgtatatgtcgcaagtttttcgtcgtagagagaatattccgacttacgtccttctacaatggcatggcctttaaacagcttgacgcgcacaacgccggtgacatgcttttgggtttctttcaggaatgcaagcagcgcgtcttttaacggcgagaaccataaaccgttatagatgatttcagacagtttttgttcaattgccggtttgaaatgggccacttctttcactaaagtcagatcctcaagctctttgtgagccgtaatcaaagtcatggcgcccgggcactcataaacttcacgggacttaatgccgaccaggcggttttccacatggtcaatccggccgatgccgtgttttccggcagtctcgttcagcttgagaattaaatcagcgagcgggtaggttacgccgtcgattgaaaccggaacaccggcttcaaatgcgatttcgatgatttccggaacgtccggcgtgttttcaagagatgctgtcaggtcatatgccccttcaggcggcgccgcccacggatcttctaatataccgcattcattggcgcgtccccataggttctggtcgatggaatacgggctgtcaagattgatcggaatcggtatgccgcggcttgcggcgtattcaatttcttcttcacgcgaccattgccactcacggaccggagcaatgacctccagatcaggatttaatgatttaatggatacttcgaaacgaacctgatcgtttccttttcccgtgcagccgtgcgctacggccaccgcgttttccttttccgccacttccacgagttttttcgcgattaacggacgggatagtgcagatacgagtggatacttgccttcatacattgtatgggcctgcatagaaatgagcgcgtactcccgggcgaattcttctttcgcatcaatcacataggaatttacggcgccaacttccagcgctttttgctgaacgaatgccaaatcctttccttccccaacatctaagcagcaggcaacaacatcgtatccctgttcttgcagccattttatcgctacagaagtatcaagacctcctgagtatgccaatacaacctttttttgttctgccatgttaaaagctccctttgtataaaaattagttttaattaataaaaatgcattttgtatgtatacactgtaacaagtaaattctgttttttcaagccttttataaaaaaaaccccacccaattttttgagcggagcagagcctttttatacatttataaatcttttcggatttcccggagcacatgaggcagttcaggaataatcagtttactcattgcaagctttacggcgcctgaggagccgggcgtgcagaagactgcggtatttcggatcacacccgctgccgctctggacaaaatggcggcggagccgatgtcctccgtatagctcagcatgcggaacagctcgccgaaccccgggagttcttttgaaaacagcggcgtgaccgcttcaattgtgacatccctttcggcaatgcccgtccctccgtttaacagcaccgcatctgtatattcatccatacagccggataaaacggctttctgcaattcatctttttcatcttttacaatgtcataagcgaccgtttcaaatcccgcttctctgatgaaatccatcatgacgcgcccgcttttgtcggtttctttcgttctcgtgtcgctgactgttatcaccttgcagcgcacggctgacggggcttcttgtttatgttcatgcacactcattgcttcacctcatcgtttatgtattaaacatatcgtaacgtttgattctggggcattcaataaaaaagcacaccctaaaggatgtgcttttttcgatcattactgtgcaagacggacaacgtcacgtgcgatcatgacctcttcgtcagtcggaatgatgatgactttgacaggagagtgagggtagctgataaacgcttcctcgccgcgcacgttgttcagcgcaggatcccaatatacacccatgaattctaagccgcgaagcacgcgttctctgacttcaacgctgttttcaccgatacccgcagtgaaaataatcgcgtcaacgccgctcattctcgcagcgtaagaaccgatgtatttatggattctgctcgcaaacacttcaagagccgtttccgctctttcgtttccttcttttgaagcttctacgatatcgcggaggtcgcttgagaaaccggatatgccaagcagtccgctctttttatttaatgtatttaatacttcatctgccgtctgatccgttttttccataatgtacgggatcaatgcagggtcgatgtttcctgaacgtgttcccatcgcaacacccgcaagcggtgtgaagcccattgacgtatcaatggattttccgccttctacggccgcgatacttgcgccgttaccgaggtggcaggaaatcagacgcaaatcttcaagcgggcggccgagaagctcagctgcgcgctgtgtcacgtatttatgagaagtgccgtggaaaccgtatttgcggatgccgtatttctcgtagtattcgtacggaaggctgtacaggtaagattgctcaggcatcgtttggtggaacgccgtatcaaacactgcaaccgcaggcacatccggaagcacttctttaaaggctttaatgccgacgatgttagccgggttatgaagcggcgcaagttctgaaatctcttcaatctcacggattgtttcatccgtaagcaaaacagaatcgctgaatttttctccgccgtgaaccacacggtggccgattccgtcaatttcgtttaaatcctttataataccgaattcagtcagcttgtgaagcagcatcttcaccgcaaccgcatgatccggaatatctgtcacttctgtatttttttcgccgttaacagagatagtgaaaacgctgtcggcgataccgatccgttctactaaaccttttgttagcaccttttctgaaggcatttcgaataactgaaattttaaagatgagcttcctgcgttaattgcaataattttagacataaatgacgctcctatcaaaattcttcttcgtttgttcgttcttttttcccagaccataactgcggtccaaaaaatatctgacttttccatttaaacattgtcaactcagcatttcaagtcaacatccacattggtaccgcttacaatacgaagtcgatattttctgataaatctcatttgtgccaaatggacggcacggccttacggaatgttattttctttccttaatttgtgttttcgccctgatttccattcattttaaaaagcgaaaagcagcgcggaattttgcgtctcacactgctttttcgccattatttttctttttgaatccactgatccaattttgccatcatctcccgcatcgcctgctggttcgcaaaagaaggaagattcgccaaaagcgcttgtttcggcggctttgcgtcttcgccttttttctgcaggattaaaatgctctttgcctgcgcttcatctttaaacatagtagccggcagctgaagcagggcgttgatatatactttttccgcaaaaaaccgcttcagtttatcgctttgcgcgctgtcaaacagatggttcggaatcataaaaaataagtatccgcccggttttgtatgtttgacgctctgctcaataaataagtggtgggcaaatgagtggccttcatccgctttcagctcaaacgcttcagcgccttcgtcattgggatagtagccgaccggcaaatcgcagataaccgcatcggccggttcgataaataacggctgaagactgtcctggcagaacagctccatttctttttcctgcagattcgcctgcgcatatgcgatcttcagaaggacatcgtcgatttcaatgccgaagctttttcccgctttgtcagaaagctggtttgccgcggtcagcagaagatttccggtgccgcaggcggggtccagcaacgtcaggccttttcggccgcccgtaaatttattcacgaggtaactgatgaaaaggccgatcgtatcaggcgtcatctgtctgttcggatgggacttatctttcagtccttttaaaatggcgagctggaacgccttgcggatccattcatgctcccattttctgaagtctgctttcgcaagcaggcttttaagctcgccggtttgtttttcctgaagcggaagctggtccgttgtttcaagaaaatacatctctcccgcctccgcaagcccctcaatataagaaatctcaaggccttctgctatcacttgggcggcttcatctaaaagttcataaatctgaccgacatgatcgtgttgcatgctgtttcctccttgccatgaaaagagctccgcggcagcacccggagctctttttctctctttacttgattaacgcttttgcagcttcgataggcttttcataattcgggtggtttgtcgcttcgcttacgtattccgcgtaaacgacttttccgtcctgatcaaggacgaatacggaacgcgccaaaagacgaagttctttgatgtaaacaccgaatgcttcaccaaatgacatctctttatgatccgataatgtttccactttatcaattccgttcgctccgcaccagcgcgcttgtgcaaacggaaggtcggcgctgattgtataaacgttcacatcaccgagttttgcggcttcttcgttgaagcggcgtgtctgcgcgtcacatacgcctgtgtcaatggaaggaataacggatatgatcgttactttccctttcatatctgctaatgtcttctcttctaatccgtttgtcaaaaccgtgaagtcaggagcttggtcacccggtttcacttcttgtccgatcagcgtcacggctccgcctttaaatgtaatttcagccattctgattcctccctttatctatgtatagctctatcatagtcgagttttatgcaaactgcaaaggttatgccgcatcgtaaaaaaagctaactgcgggcggcagttaacttttctgttataaatcgatatccgttcttttttggttccggcctttttcattctttttaaacatatgctggatgcgttcaatcgtttgaggcgcggagtctaacagtttatcaatcagatgggtgttttcgtctaaatgaagcatacgcacgccgtttgttccgacaatcagaaacgcaatcggcgtaatggatactccgccgccgcttccgccgccgaacgggagtttctgctcttttctttcatcatcatcggttcttttttcagccggctttcctccaaactcgcttccgcccgccgcaaatccgaatccgacctttgaaaccgttaagattacgctgccgtcaggcgtttcaacaggatcgccgatgattgtattcacgtcaatcatttcttttaaattttccatagcggttttcattaaaccttgaatggggtggtctgccatatgcgctcctccttaaactgatgaatcattctttgaagcaaccggaaccggctgtttctttcgtatgatagaaagtccgttccgcccgtatttgagcaatttgaaagctgcacctataagatgtccaaaacgaaaaaagaatatacactgcaaatgcgtcttggatgcaggcacttgaaaagacggaatgacttcgcacaccggtttatgtatgaaacgcagatgatcatacagcatcgccgtaaggcctccctttacggcccacaatccgccggcggcgattcccgtaacggcggcgtcctttattccgataaccgtcacccattcaaacttcgtaacacggactcccgcaagaaatgaggcggcgatttggcgcatctgcaagacttggtgcagaatcatttctattctgtgaatgctctgtttgacatcttcatatgtgatttttttcttctcttttttctgacctttcatttctgatttcgtgtcctgtttgacatcaatagacgcgtcttcgctgtttactttaatgacgggcagcgtttttttaaaacggaccagcccgtataaggccgagagtttaaacgtcagtttgtcgttatctttatcgtgaagatattcgaaagtcagatggattttcatcctcatgagcagccagaccaaaatgagaatgagaataacagctgctgcggcatatcccataggcttcacttccttagcagcattatcgccaaaaccaaaaaaaataaacccggacgtttattccgggtttactgcttttatttgcggtacagcgcttcgtgaatcaccgttgtgtcggcgatcagatcgtgaatgccctgctttttgggcgtaaacgcaatgacgatatagagaatccagattttatcgatataacgccccaccgcttctctgaaaatgacggtgctccaagtcagcggctttccgggcgtcaaagaagtgacctttaacccgaagaccatcttgccgagtgtctgatgaaaccatttcgtcatgaacacaaaataggcgaggtagacgatcagggttgtgacggaataagctgagattgtaaacattccgcttgttgccgggagcttcatcagcgtgaaaatcggtgaaacgatgagatggttaagtccccagaccaccagccaatcaagaagaaacgcccaaaacctgatccaaaagcccgcatatgcctgctcgggcgccctctgttgttcggcttcctcttctttgccgtgaaagccttcgtaagtcgcgtccattctttcttcccccctactttgcatagagatacatcatccgcggcgaaccggattgcgaaatgagttctttcatattcagaaaatcaatttcgcttttaaacattttcgctgcgctcatggaaaagagcgagcctaatccgaatccttcctcgtatgtgatgactgaagcgtttttcatatttttatggtcctttttcatcgcgctgatcgtatcatcgtaaaaaccgagctcatcaacgaggccgatttttttcgcttgtctgccgtcgtaaacacggccgtcggcaatttttttcacatccgcttttgacatgtgccggccttttgaaatgacattgacaaatccttcataagaatcgttgaccattgtctgcatgatctttctttcttccttcgtcatgtcgcgggtcggggacatgatgtctttatgcgcgccgcttttaatggtttcaaacttgatgccgagttcatcggcgagcttggaataattgacgctttccatgatgacgcccagtgaacccgtgagcgtttccggtgaagcatagattttatcggcggccgttgaaatatagtagcctcccgatgccgccatggagcccatggacacataaatcggtttcttcgtttctttctttagttcttccagttttttatgtatttccgcgctttcgtacacgcctccgcccggggaattgattttcagtacaattcctttgacgcttttatcttctttcgcacgctcaacctgttttaaaaatgatctgtgatcatacccgcctgagctgagcaggccagcggacccgccgttatcctcaatcgtgccgtccacttcaagcacggcgattttactgccggggctgcccttatccagcgtcacttcctctgtgtcatctgtcagtgatgcaaagtcagaccctgtatctccgatattcttcagcaccccgacggtcacacttgcaatgaccgatacgccgaaaatgccgagcgcgatgacgagcgcaatccatctttttgcattcatttgttctcctccttttctgtcaatattcgtacgttcccccgtaaaaaaagattcatttttttcatgaagcgctttctcttaacggataaacaggaaacatgttacactattgccacaggtattttaacacaatacctgctgggagaaaaacgtaaatatgacagcaaaggggaatggggatatgaccgatcttcgccgcaatgtttatttttttcacaaacaaaacaacgaaacaaaagaacaagtcagctctttgaagcagcttgctgaatcgcacggttttacagttgcggctcacccggaggatgccggaattatcgccagcatcggcagcgacggctcatttctgcaagccgtcagaaaaaccggattccgtgatgactgcctgtatgtcggcatcgctaaaaaagggaaagcccatttgtactgtgattttcacagcgatgagcctgaaaaaatggcggccagcatgaccgcggaacagcttgaggtcagaaaatacccgctcattcatgtaacggtggacggcagcaatcattttcactgtttaaacgaggtttccatccgttcaagcattattaaaacgtttgtgatggatgtgttaattgatgatcttcattttgagacgttcagaggagacgggatgatcatttccaccccgacgggcagcaccgcctacaataaatctgtttcaggcgccgttgttgatcctttgatttcctgcatgcaggtatccgaactggcgtcgttgaacaacaacacataccgtacactcggatctccgtttattttaagctcagaccggaagctgacactgcaggtggtccaggacggcaatgagcatccgattatcgggcttgataatgaagcgctcagcacgcggaatgtcaaaaaggttgagattacactatccgataaaaaaatcaaaacggtgaaactgaaagacaactctttctgggaaaaagtaaagcgatcatttttatcataaaaaaagaggacgggcatcactgcctgtcctctttttcatatacgatacggccgccgacgacggttttgacagcttccaattcatgaagctttttcggatccgtcccgaacggatcaccgctgagtacggtaaagtcggcatcatagccgggggcgatccgtccgcggctatgttctttatggatgatggccgcgcttccctccgtgtaaagctgaatggcttcgtacacggtcaggcactctttttcataataggccggaccttccggatgctgcttgcttgtacggagcacagccgattgaatgcccagaagcggatcggccggctcaatcggggcgtctgagcctccggcgcacagcagcccttttgacagcagtgttttccaggcgaaagccgttttcatccgctcttctccgagccggtcaatcacccacggaaaatcactggccacaaaatgcggctgaagatcaagtccgatcggcagccgggcggctctttcaatcaatccggcatctaatacttgcgcatgaatgagcctgtctagctgtccgggctttgccgggtatctttcgataacatcgagcaccttttcaaatgcaaggtcgccaatcgcgtgcacggcgatctccatccctttctctctcgctttataaacaagagcggcaagggtctcgtcatcgtgcacctgaacgccggaaactgacggatcatcatgataaggctttttcaacagagcggttctgcctccgagcgcgccgtcagcaaaaattttcatcgctccgtattccaggtaaggtccggtcgatttatccagagcgctccagctgtcgacggcttcgtgatgaacgagcagatgggcgcgaaaaggataaaggccgctgccggttaaagactcgtacgcggcaacgggaacggacgcgtctccgtagtatgccagatcttctgaatgcccgcctgtcaggccttttgaccagcagtccgtaatcgccgtttgaagcgcgcgtttgacatagtgaagtgagacgggcggcagggcctgtgtcacaagctcttgggctttatccagcagaaggcctgtcggaccggtgccgtcccggacgataatcccgccgtttggatcagatgtttcgtttgtaatccccgccgcgcgcaatgcggccgaattaaccgcaacggcgtgccggcatacccgcttcagcaggacggggcggtcgggaaagagcgggtcaaggtcatgcttcgtgacgtaatccggccgttcaaacaggttttcatcccagccttcgccgatcagccattcgccatcttccaattcacgctctgcttcttttgcggcccgcaggatcgcttcttttgacgtcagctgcgacaaatcgaggcgaagctgtttttccccgtgtccgattaaatgcatatgactgtccgtaaaccccgggaacatgacagctccatgtaaatcgatttcctccgtatcaggcgaaccgtatgttccttggagctcccgatagctgcccgtcttcctgacgacgccttcttcggtataaacggattcagtgacatgattcttgtcaagcattgtatagatggtgccgccgtgccaaatcgctttcatccccgctcaccctttatcctgtattatgcttttttatcagccttcagccgttcttcacgctgtctcagttccacacgtctgatttttgcggacgccgttttcggcaggctttcgacaaattcaatctctctcggatatttgtaaggcgccgtaatcgtttttacgtggttttgcagttctttgacaagttcgtcactccgcttttcatcgtcttgtaaaacgacataagcttttacgattgaacctctgatttcatccgggcttgccacgactgcacattctttcacttccggatgcttcacgagcgcgtcctctacttcaaaaggtccgattgtatatccggagctgacgataatgtcatcattgcggctctcaaaccaaaagtagccgtcctcgtcttttttcgcgcggtctcctgtaagaaaataatctccgcgaatctgctttttcgttctttcgggatctttataatattccttgaataaggccggtgtgctcaaatgcacggcgatatcgcccgtttcgcctgtttcgcatatttcgcccttatcgtttataatctctacttgatttccgggggtcggtttgcccatgcttcccggcttaatatccatatccttcaggacgccgactaacagggtgctctccgtttggccgtatccgtctctcactttaataccgaaatgcttccggaatacgtcaatgacttcccggtttaatggctcacccgcagaaactgcgctgtgaagggcagaaagatcatatttgtccaactcctccacttttgccatcaggcggtattccgtcggggtacagcagaagacatttacttgatggcgctccagcagctctaaatacgtcttggcgttgaatctgccgtgataaatgaatcctgtcgcgccgcttcccagaacggcgagcagcgggctccacacccatttctgccaaccgggcgccgcggtggcccacactgtatcgtcttcggaaatatccagccatgcaccggctgatgtttttaaatgggcaaaggcccagccgtgtgtatgtacaacgcctttaggctggccggtcgtgcctgaagtataggacaaaaacgccatgtcctctcttgttgtatcagctgtttgaaaactgtttccgtccgcttcaatcgttaagaggtttttccagccggcatcattttcaccgattgacaatgtcaccagctgctcggtattcacctcgtcaaatgcgtttataaatgaaggataaacgatagcgcctttcacttcggcgtgtttgatccggtattcaaggtctttggcgcgcagcatttccgagcaaggaatgacgaccatccccgcttttaagatcgctaaataaacggcatacgcttcaagcactctcggaaccatgacaatcagcttatcgcctttttcaaatccgagacctttcaggcgggctccgattttattcgtttcttccatcaatttttcatacgtccagactttcttgccgcctgtttgatcttcccaaataagcgcgttcttctctttggaacggctgaacttttcgatttcatttacaagattatagttctttggggcgattaaatcttctcgttttaacacgaacaactcctcactttctttccccattatacataaacataggccattacaataaaaatatgcataaattgcttccagccttctatctatactcatgaaaaaagagcggggaattccccgctctcttagccattatgtgaagttgtgattaaaactgctgctggctgcttccgcccatgctttgctgagcaaaagagacaagacgttttgtgatttctccaccgacagaaccgttggcgcgagaagttgtttccggtccaaggtttacaccgaattcagaagcgatttcatacttcatttggtcgatagcttgagcagcgcctggcactaaaagctggttgctgtttccgctgtttgattgttgtgacatgtgtatcacctccttgtgagtatagaatgtgataaaacacatgtcttcattcaaaaaaactttggtaattgtatacagttttaaaacaggccggcaaacttatcgtgagcttcctgctctgagtaaacagtgatggtttcgatgccggcagcggcctctgcaatcagcggttcaaaatcaacgaagctttcgaagtgctcgattttttcttttttcggacgcgttttcggacttggcggcgtaaagatggtgcagcaatcctcaaacggctgaatgcttgtttcataagtgccgatttcttttgatttctcgatgatttctgttttgtccattccgattaaagggcgcaaaaccggtgttgccgtcacggcattgatcgcatacatgctttcaagcgtctggctcgctacctgcccgaggctttcccccgtaatgatcgcgagcgcttttcgttcttctctgattctgtccgcgatttgcagcataagacgccgcgtcgccgtcatcgtatagttttccgggatttgtttttggatgagttcctgcgtctttgtaaacggcacgatatgaagcgtcatactgccgccgaacttcgcgaggcatcccgcgagatccatgactttctgctttgcccgttcgctcgtatacggcggactgaagaaatgtacggcttcaactgataatccccgtttcatcgcgtaaaaaccggcgaccggactgtcaaaaccgccggaaagcatcagcatcgctttacccgcggaaccgacaggaaggcctccggcgcctttttcgttacgaatggtcaggaatgtcgcttcctccctgatttcaatccgaagcggaatatcgggatttttcacatcgacggttaatccatccgtgtttttcaaaatatggccgccgatttcagcgttcatcgcattcgtatctaattcaaactgcttgtaagcccgtttggtctcgaccttaaacgtattccccggtttatattcgccttctatcgcggctaaagccgtttttttaatgtcttccagcttgctttcgcatttaattgcgagactgaaactttgaatgccgaatatattctttaataaggaacaaattccctccgggttttctccattaagtgtaattgacatccggtcccggtttgaaaagtattttacttttttataatcctttaataccaggcggatattttgttttaatctttcaataaaactgcgtctgttttttccttttgtggatatttcaccaaaacggattaaaatatgatcgtaattcatatgctacctcatcattttttttagtttttgaacagccggcaccagcgcggccataaacggctccgtgatgtcagccgtatgcatgaagttcaggctgactctgatgctgcttgatgcaacctgttcgcctttattcatttgcagaagaacacggctcggtttatgctctcttgccgaacatgccgcggttgtggagacatatattcctttttcctcaagcatgtgcagcagcacttcggccttcacgcccggaacggaaaaattaatgatatgcggagcgctgttttcggcgggagtgttgatgacgaccccgtccgccccgctcagcctttccatgagcgcattcttggcagcctccacggaagaaagccgctcattcatgtcacgcgcggaaagattgatcgctttcgcaagggaaacggcgcctgccgtatgttctgttccggcccggacgcctttttgctgcgagccgcccgttataagcggaatgagccgcgttccttttttgacgataagcgctccggtcccttttaagccgtgaaacttatgccctgaaacagtgcaaaggtcaatgcccgcttcttctatagacagaggaactttatgaatgccctgcacatgatcaacatgaaacagaatattccggtgctgcttcaaaaacccgccgatttcctttacgggctgaatggagccgacttcgttattgacatgcatgacgctgacgattatcgtatccggcctgatagccgatttgacgtctttcaaagaaacgaagccgttttgatcggccggaagatatgtgacttcaaagccgaacagctctgtcagctgatcaagcgtctccgtcacagaaggatgctcaatcgccgaagcaatgatatgtcttcctttactcatgtttgcccaggccgctccctttaacgcagcgttattcgcttcagtcgcgcctgatgtaaatacaatatcataattttttaaacgtaaggttctttttatttgctgagcggccgcttcaaggagctgctccgtctcagttcctaactggtgcagagacgaaggattgccgaaataacggctgctcgtctgtttatacacttccaaaacctcttcatacggctcggtcgttgagctgttgtctaaatatatcattttttttactccttttatgaaaacggtacatcgtatgatatttatgctaccataacaaaagtaaatagaaattcgcaataaatcgagtattgacttctctgtacattgccatataataagtaatgttcgttttgttatattatctgacaattaattgacagaatatttcaacatagtatttaggaggacttttatgaaacactcactacctgtcaaagataccgttattatcggtttcatgctcttcgcactttttttcggggcaggaaatatgatatatccgccggagcttgggcaagcggcggggcataatgtctggaaagcgatgggcggtttcttactgaccggcgtaggactgccgcttttaggtattatcgccatcgcattaacgggcaaagacgcgaaaggacttgccgataaggctcacccggtattcggcactattttcaccgttgtgctttatttatcaatcgggccgcttttcgcgattccgagaaccggaaccgtttcatatgaaatcggtgcagttccgtttttaagcggcattccggaaagattatctttatttgttttcacgttgatctttttttctattacgtattatttagctcttaacccgtccaaaatcgtggacagagtcggaaagattttgactcccattaaattcggtattattttaatcattgtcgtaaaagccatcgtcactccgatgggcgggctgggcgccgtacatcaggcatattccggaacgccggtgttcaaaggatttttggaaggctataaaacaatggatgcgctcgcctcaatcgtcttcggcgtcgttgtcgtcaacgctgttaaaagcaggggcgtcacccagcgtaaagcgctcgccgccgcttgtattaaagcgggtctgattgcagcggcgggtttgacattcatttatttatctttggcctatttgggagcgacaagcacggacgctgtcgggccgctcggcgaaggcgcaaagattttatcagcttcatctgattacctgttcggttcactgggaaacattgttctcggtgccgccatcaccgttgcgtgtttaacgacaagcatcgggcttgtcacatcttgcggcgaatatttttcaaaattgattcccgctttatcatacaaaatggtggttacgattgtcacgctgttcagtctggcgatttcaaatttcggacttgctgagattattgcattttcagttcctattttatcagccatttacccgctggcgattgtcattatcgtactttcctttattgataaaatctttaaggaaagacgcgaagtctatatcgcctgcctgatcggaacggggctgttcagtatcctggacggtttgaaggcagccggcattccgctcggatcattagattcattcttaaacgcaaatcttccgctttacagcatgggaatcggctgggtgcttccgggcattgccggagcgatcatcggctgcatcatcacgttttttatcagcccgcccatcgaattaaataaagcaaaatcgtaacattcagcgcctgcggtttgatgtatatcagccataggcgctttttatattccgtgagaaacaaaaaaactgcacctctgatttccatcagggtgcagtttttgcttgtgcgtctatgaagcagattgatcagctttaatttttttcacggcgccgggagctgctttttcaacagcatctgccgccatctcataagcttcattatagctgtaagcgtaaaacagccgttccgcttctttcagctgttcggataaaatatgattctggcttcggaaacggttgccgtactgaatgatccgctcaatcagcttcacctgaatcacaagttcttccgcctcttcgctgacttccgcaaccaccttttcagcttcggtcagatgtttggcggcttcctccatgtttaacggcagctcttccaattggctgacggtctcttctatatgatgatttgccgtctcgagcttgtccttgacttgttcaggaattcccggcacgttgcttttttgcagcattcgggccgtgtcagaaatggttttccgaagattcatcagcgtttcccgcgcctgcagttcttcttttctgagcgcctgcagattttcacggtattcggcatgttctttctgagcttcttccatctgcttttcgatggcctcgacttcttcaatcagcagcgagtaagcgacatgctcaccgtcaagcttttctctcgcctgctcaaggagccggccgatcgtttccagctgtttttcgaaagcatgctgtctgccgatttctcccgccgtcagctgatagctttccttgacgagctccgtttcggtttttgtgcggtctttttcttcctcaagcttctcatacgcgatgatcagctcaggcattttgcttaatacggactgtccggcttccacttcgccttccagctgttcatacatcgattgaatggtttcatcaatcagctgaagaatggcggacgcttcgtcgacatctaattcttccaaaagcgcgctttcggcccgtttcaattgattggtgagtgtctccagctctttttcgatttgaatatgctccaatttgtagcctttttccgtcatttcccggtagccgtctttcagcttggcaatttggttaggcacggtctgtttacagtcagcgagcagtttcggaacgtcatctatgtatgtttgaagctgatccagtctgcggtcctgttcaagcagcacttttctcgctttgatgtaattgccgctttccgtctcttcttcgaacttttttatgccgctccagatttcgtcgagatccgtctccaggctgttatatagctctccgtagagatggctatacgccagaaggttttttcgcgcttttgaataccgctcacgcacctgttcaatctctccgcggcttttttcctcgctcgtcacaagatcgctgatctcacgcagtatgccttctatatttgattcggctgcagtgaggaggtcgtcgatgtggacaagcacctgattcgcttttttaaaccggtatttgtcggcgttctcttcggcatcataaaggagctcttctactttcggcagatgggctgtgacaatttcatcccactcttcgcgccatctttcaaagaactcttccgtctctccggtcattttcagatgtttgatcttggacatttcttccactatcgaacggtttaaaatttcaatcttccatgactccagccggtcaatttccgtataaatttttttcctgaaaaagtagcccgccgcaaagagcgcgagcagtataaccaataatccgatgactaactccataatgagcccccttgttgttctcttaatctgtcagggtgttttatgtattcagaaagatttcaatatatgtattgagaaaatctgtcgttttcattgttattatgataccatgtaaccaacattttttgaccagaaatcaaaaactttttgcataatttcggcaggattctgcaattttttaatggagtgacacaaatggaaaaacgagacgctcatatccacacgcctttttgccctcacggctcgaaggatgcgctgaaagaatatgtcgaaaaggccctggaaagaggctttgactcgatcacatttacagagcacgccccccttcctccgtcatttcaagatcccgtaccgcttcaggacagcgcgatggatctcagacagatggaggtttatttggagcggctgtcacagctgaaaaaggaatacgatggacaaatcagcattctgaccgggctcgaaactgattttatcacagggtatgaagaggaaaccgcggcgtttctgaacacgtacggcccctcactggatgacggcattttatccgttcattttttgaagaccggtccgtcttatatctgcctcgattttgacgagcacgcctttcagcagctcgccgcgcacttcggaagcgttgaagccgtatatgaacaatactatgaaactgtgtattcttccattgtaacaccgctcggcccctttaagccaaaacgggtcggccatatcacgctcgtcaaaaaattcgcacgccttttcccttacagcatgtcacctcaaataagagagcttgcggcccgctgtcttgacgccgtgaaagaacacggaatggagctggatgtgaatacatccgggctcagaaagaagtttgccggggaagtatacatggaggattggatggctgagaccgcgaagcaaaaaaaaatcccgctcatattcgggtcggacgcccatcaagcggaagatgtcggcagttcctatgaaacgtacaaaagcatcattacttcataagcgccgcatcaggccgtcggaacacgctttcgatccagatcttcacctcttcaaaataccttttataaaagtacggttcatgaggctgcatatagagcacctctgtaatgtattgaggctgaagatacggcatcatcaagagggatttcaattgcagaataaaatgcggcacgggcagcgtcagccgtctgtggcgtgactgcccttcttcaatcaccagctggaaaatatatttttctttcattaagtaagtagacataatttccctgataagcacggaatcaatcgtcacttcccggtacacaaaccgcgttagttgacggttatcgtgctgataggataaaatatcgaaaatcacccgcaggatgcgttcctgcgcgtcttcaccgttcaaactgacggcggctttttccagcgcttcagtatagccttcgtaaaactcggaaactaaatgttccattaatccgcctttccctttaaaatagtaggagatgtgcgcaacattaacatcagctgactttgcgatttcacggacggacgtgccggaataacctttttggttaaacagctggacagcggcgttaataattttgtctttggtgcttactttcatacggctcacccctttatgtgtaacaattcaagcagaaaggcgccgttcctgtaagaacttctcgacaaatgccggcagaacggccggaactttgtttgatattatagaaaaagtgagggttttccatgtttcatgtcgaaaaacaatccggagataaagaaaaaagttatcagcttctgcttaaacagctcgaagccatgacagaagatgaaacggatgcgatcgcaaattacgcgaatgcatcagcgcttttataccattcattacatgaagtcaactgggcggggttttacttcgctaaagagggcgagctcgtgctcggaccgtttcaaggacttcctgcctgtgtgcgcatcccgttcggcagaggcgtatgcggcactgcctactctaacggcgccgtgcagcggattgccgatgtgaatgcgttcccgggacatatcgcctgtgacgcggcttcccagtcagaaatcgtcctcccgatccgcgtaaacggtgaagtgatcggtgtgctggacattgacagccctgtgaaaaaccgttttgatgaaacggacgaagcctatttagcaaagtttgttgaaacgcttgaaaaacgattaggataaaaaaaggagcccggccggcaggccggctccttttttatgtcgtcgtgctgttttggtggatgatcagccggtttttgccgttccgtttggcgatataaagcgcctcgtccgcttgctgaacgagcattttcaacggcatcgggcctgtctttgaccagcaggaaacgccgcaggaaatcgtcacgcgcggctcggtgttttcccggatggcgcgaaccagccttttagcgatgcgttctccggatgacacgttgatattcggcagatagacagccagctcctcgcccccccaccttgcagcgacatcatgctcacgaatatggtttttcataacggaggccacctgaatcaggatcgaatctcccgtttgatgaccgtatgtatcattaatggttttgaaattatcgatatcaacgaggatgaatacaccccgtttatgaattttcatgctgtattgaattttctcatccaaataggttcttgaatacagctccgtcagctggtctgtctgaacaagatgctcaagcctgtcgcgcagcatggagttcgtgaccgccaatgtcgcatggtgaatgagcgcttgaaaaagcttatacatttcaaacgtaaaagcatacaaatcctttttcaataaaatcgcgaacccgaagacggtgtcattttcgatcatcggcaccgccatcagcgagccgaagccgttttcgccgaatacagtctttccgctgccgataaacacgcccttttctccctcgaacagcttttctttcacaatgctgatataggggttcgcacgttctgtcttaaaaaaagcggtatgtcccggaagcagattttgcgtctcaaaatgatcaatatgaaaaaaagccacttcttccgcatgaaatgattgggtcataatggcggcgagttcccgcatcgtgtcagtgagtctgaggcgctgattcagctggcgcgatgtttcattaatgagctccagattcgcaatgctttttttcgattgctcatagagctgcgcattttcaaatgcttttcccgccgcgcccgcaagcagcagcatttcactgagagtactgcacgaaagaacggcatcctgcagcccctccgtcttcagaaccccgtaagtcccctgctggcctttgatcggcaggtaagcagatgacctgccttttctgagcagtctccccgataaataaaccttcagggcagacggatcggcatcttttccatccatatgtaattcttttgcgggaagctgtctgtccgtatcctgatcctgcgtgataaacagtgaaaagcggaaagaccggaaagccgtactcaaacttgcctgcagtttttccaaaacctcattttgatccaaaagcgaatggaacatttctgtcattctgtgaattttccgctgatgcttcgttttgtcaaacagcccgctttgtctcacagattgattgataaactgagtaacgatctcaggcaatgattccgggatcggcagcccgccttccgagcgcagataaaaggatctgccggacgtctgattcctgatcataaaacggccgtcactctctttcagcggagcataatgcggttcatcttctgtttttatggtgaaacgtgttgattctgccggtgaaagggtcaatgaaagagatgtaaagcaggattctagagctgaggccagccataacagcgagtcggataatgagacggattcagatttcgttaagaaaaaagaaagcattttctgatgaaaggccgtcacttcatcaattgtttgttttttcatttttatcacctaaacatgtactactcatttttgtacattatatcataaaccggcactcttcatggagaaatggttgacggcggcggggaaaaatcatataatgttctttgtgtgaaatattgcagcctttttgttcagcttctgtgtttgcattttgttccttagctgtaaggtgtatcgtgtaactctctgctgctggagcgaggatacatgaaaacaaaatgtgcacggtcggatcgaacagacggtttttattttccacaaaataaaaccaaaggaggagtcacattatggctcgctatacaggtccatcttggaaactgtcccgccgtttaggaatctctcttagcggtacaggtaaagaattagaaaaacgcccttacgcaccaggtccccacggtccgggacagcgtaaaaaactatcagaatacggtttgcaattgcaagaaaagcaaaaacttcgtcacatgtacggtgtaaacgaacgtcaattccgcacattgtttgacaaagcggcaaaaatgactggtaaacacggcgaaaacttcatgattcttttagatgcacgtcttgataacgttgtgtacaagctcggtcttgcacgcactcgccgtcaagctcgccaattagttaaccacggtcacatccttgttgacggaagccgcgttgacattccgtcttaccaagtaaaacctggtcaaacaatcggtgttcgcgaaaaatcaagaaacctttctatcatcaaagaatctgtagaagtaaacaacttcgttcctgagtaccttactttcgacgctgaaaagcttgaaggtacattcactcgtcttccagagcgctctgagcttgctccggaaattaacgaagcgcttatcgttgagttctactcccgttaagtaaaacgctctttaaagagcattggattaaaccccggacatgttgtgatgacaatgtttccggggtttttcttttgggctgttccctctctttattaaaaaagcccctgtccggggcttttttttatgtgccaaccggcttttcaactacatgtacattagaaaaccccataatgcctgcaacagataatgccgcaaaaagaattctctttttcatcaaattcctgccgaaacgcagaaatgagtttgttattttttctgactcaccttaatcatttgacaggcagaagcgattttttacataatgaatcatcatacttacaaaaaggagagacggaatgaacagcatcccctctatcgtcagcaagcacaaagcctattttgcggcggggcatacgagaccgctagaatcaaggctgaacatattgcaaaagctgaaacaagccatcaaaacacaagaagccgatatagcagccgctctctatcaggatctccacaaatccgaacaggaggcgtacacgacagaaatcggaattgttctggaagaaatcagttttgtgatgaagcggctgagaaaatgggtcaaaccgaagcgagtcaaaacgcctctgactcacctgggctcgaaaagcatgattatccctgagccatatggaatcgttttggtgattgcgccttggaattatcccttgcagctggcgctttcacccttgattggagccattgcggccggaaacacagtcgttctcaaaccgtcagaatatacgcctgcggtttccgctgttctttctaaacttatcagcagcgtttttccgagtgattatgtcgctatggcggagggcgggcccgacgtcagcactgttttattacagcagccctttgactatattttcttcacaggaagcgttgccgtgggaaaaatcgttatggaggccgcctccaaacaattaattcccgttaccttggagctcggcggcaaaagtccctgcattgtccataaggatgctgatatacagcttgccgccaaacgcatcgtcttcgggaaatttacaaatgcagggcaaacctgcatcgcaccggattatttagttgtccaccaagatatcaaaacgaagctcatagaagaaatgaagcatgcgatcagtgaattttacggccctcagcctgaacaaaatccgcagtacggcaaaatcgtcagtgaacgccactatcagcggctgctcagctttctgaatgatggcgtcccgcttacaggcggacaatttaatcctgaacaccacaaaatagcgccgacgattctagatcaagtgaaggatgactctccagtaatgcaggaggagattttcgggccgattcttccgctgtttacatacggcgatatcgatgaagtcatcgagaaagtccaatcacgcccaaagccgctcgctctttatgtcttcacaacaaacaaaggaatcgagcgaactgttttagagaatctgtcatttggcggcggctgtgtcaatgatacgttaatgcacgtcgcgacaccgtatttgccattcggcggcgtcggagaaagcggcatcggcagctatcacggatttaacagctttaacgcatttacgcacaaaaaaagcgtcgtcaaacaaacgaaccgcttcgacctcgctttccgttatccttcttccaaaaacgggctgcgaatgatccggaaaatacttaaataaaaaagcgcagagtatctgcgctttttataaatcatctatacaccaattaatcggttcgtctcccaaattaaacctatttttaaaagttcaaatcgaagtctaaccgcaaaaatgaaccaacccaactgtaggaaaggttaatccttatcaccctggtgagtcctataataattttcagcggtatagatattccactcccaaaaatttgctccttgacacaaaatataccgatctaaaaatatctcaaaattaagtttcattggttcatactcaataaatccgcggaaccataaatagtttggatctgtagaaattttggttttgtcaattaacaaataacatccgtctaacagatgtgcgacaggaataaactgaggctctaaaaaaccattttgcatatacttttcaatctcttctaaatcaagaatatgcaaaccccacctacattctcaccgtaaatcaacaaatcaaatattctggctccgttatgcaattttaaaaaggttttataatcttcaggaagtgagacttttattttcttctcaaaactctcaatctccagatctgttgcacctttaaagaaagtacattctgtttctaaaagcgttccttcattccctaaaatgttcaagcggcctttttcatcaattaattcttttagaccttggagcgttttttcaacaaaaactgccattgagccacctcttattattagagcattgctattttattcacaagagcaggagccaatgttccagttgaagtatcaggaagagaacctttccatccggctactgaagtatgttgggacataaaaaactttgtctttttaggataatacgactttgaatatgatttacctgcttgaaaattctatgttatggggaaaacctttcgtattaaacatataaagacagtctgttaaacagactgtctaagatgttgttacatcacaccatactcagctgcggtttaaataattcatagtgaatggattccggcgttatattgaattcagaaatcagctttttcatttctttaatgaacgacggggatccgcacaggtaaaaatcagcatctttatctgtcatcacttcttctaacagctgtttgtcaatccggccttcccgaaaacgaatgttttctgaacggtcttgttcggacggttcgctgtaaataaagacggtgtcagcggatgagtgttccgcggcttcttcagcttcatgccgcagcgcatgatactctccgctccttgccgcatggataaagagaacgtttcgctgcggctgggttttggcaaccgtctttaacatgctgatcatcggggtaattccgacaccggcactgatgagaaccagattctttttggaatcagggtctaatacgaaatccccggccggagcgctgatctcaattgaatccttttcgtgtaattggtcatgcagatatgaagaaacaattccgtcttttttcacggaaatccggtaataatccttaccggatacatccgacaaactgtactggcggatatgcgtataacccgtgtccggaatgtatacttttacactgatatactgtcccgctttgaattcggggagaacttgtccgtcttccggttttaaataaaacgacgttatctctttgctttcttttacctttttatcaattttaaacgccttatcgtctttccagccgcctttttgcgtttccgcttgtttatacatgtccttctcaattccgataaaagcgtctgcaatgacgccgtatgctttttcccatgcctgaatgacctcaggagcagccccgtcttttagcacatcctttatcgcgattaacaagtactttccaacgattggataatgctcgggcttaacaccgatactccggtgcttatggctgatttgtttgacgacggggactatgttttccagccggtcaatattggctgcggccgcaatcacagcattcgacaaggccgtacgctgtgtttttttcttttgattcgtctgattaaagatattcagcagctcagggtgatgctgaaaaagcaggtcataaaatcggcctgtgatttcttcaccatgctcttctaagaccggcactgtgcttttaatgatttcaatcgttttttcatcgagcattctgaaatccccctaaagatgtatgcatctcgattgacctgaaaaaagaatcgtttttgaattcttttttatagatttccccgttcaaaaagggttagccattccaatttgagacggattcaggaaaaaccagataaacgaaattgcggatggaaaattgtggacttgccatagtgtacttgtccgatgcaaaatcctccttttcagcatttaataaagtacgggaggtgagatgaatgggtaaaaaatcgaaagtgtattactgtgaccctaagtatattgtgactgacaagtatactgacaaagaagtggtttacgtccatcccatcaaacacattaacagagaacatatccgttatgttccccgccacgtttatcaggaagaaacaattcacgaagtcattgatccgggcgatccggggaaatgcgggtgtaaaaaggataaaaaaagacgcaaaaagtaattggttcgatttcttgcctcagcagacctccgtaccttttggctcctctttttcagaggggtcttttttcatgccgtatcttcaagcaaatacgttgtgaggcggcaatccgcctgatattcttgtcatatacaaattcacaggaggcatgatgatgagcaaaaaaatcgcagttctgatgacagatcaatttgaggatattgaatatacaagcccggcggaagcatttaaagaagcgggccacagtgtggtgacaatagatttagaagcagggaaagaagtgacgggcaagcacggtgagaaagtaaagatcgatcaagcgatctcagacgcagaccccaaggaattcgatgcgttattgattcccggaggcttttcaccagatcttctgcggggagatgaccgcccgggtgaattcactaaatcattcgtggaaaatcagaaacccgttttcgcgatctgccacggcccgcagctgctgattgataccgaccttcttaaaggaaaagatatcacgggattccgcagcatccgcaaagacttaatcaatgccggcgcacattataaagatgaagaagtcatcgtgagccataacatcgtaacgagcagaacgcctgacgatttggaagcctttaatcgtgaatcattgaacctgctgaaataagcgaataaaaatgcacagacccgttcagtctgtgcatttttttatggattgataaagaaacaccaatagttagacctattctcttccccatccataataagtaaaataaagagtgggtttttcaacactcgacgggaggttcacttatgtggatgatcattttgctgctgatcattttaatcggttttaccggtaatatcatttcgcttttgagagcgcaaaaacacgcatctcaaagaataattgagcttttagaaaagcaaggccgaaaataatcatgcagcgctgtgttacccgtaatagtaataataattccggcagatttcctgaaaaatgatttgatgccctttctcgttcggatgaagaccttctgacatgcacatgctgcggaaagcgggattatacgggtcgatgagatctgtatcaaacaggtcggcatacggtacagagaggagtgtgcaggcttctttttgggctttcacatagtcagccagcttcaggcccagtttatttttatcagtatcacggcggacgatttttccttttgatatttttgcttgtctcgttggggtcaccacaatggtgctcgcgcctttatttccgcttcgcagctgctgaatcacttgacagaagcctccgtaaaatgtggtgatatccttttcatctgtgccgatgggaatgtggttgcaccaatcatcatctgttccctggacaatgatgacatcatgtccctttgttttaagcgcttgctgataaatgttatcgcttccgtggttgctcatattaacgccgctgacagacagattggttatttcagcgtctgtccggtctttcagaatgtcaccaaagccgtattccgcgcgcagcccccgggcgacgctgtcacctaagatcgcgatttttgaagccttccgcagcctgcttatgctgatgaagtcaatgctgatatgcccgctgtccgtgatatgcaaaagcttgctgcttatgttttgcgaagagactgtctttccttcagagttataaaattcctcattcagcttcattcggcgtcatcccttcctttttatcctccggcatcttttttgacataaaaaacggacacgaacaaacagcgccatgttgtcagttcagtgtccgcagatgatgataccggatcttttatgcagttctcttgccattatagcagatctccattacttgtaatagagtctgcttcagcatttaaaacagcgcttgcgggtacgtttttgatgtgaccgtctgctgcgggaacggtgtgtccggcgatgcgtccgtcttctgctgcgggaacggtgtgtccggtgatgcgtccgtcttctgctgcgggaacggtgtgtccggtgatgggtccgtcttctgctgcgggagcggtgtgtccggtgatgactccgtcttctgctgcgggaacggtgtgtccgttttctgctgcgggaacggcgcgaacattttttggaaaccggttcttggtataaatactcccctaaaccttctctttccgcaacggcaactccatgttcaatttctttaacagaaatagcgttcaattctgttcacctccctttttctttacaacataacgtatgaaatgtacccctcacgtgtataagcttctctctcatatgagcgagaaatagtcatttatacaacaaaaagacccgtggaaacgggccttttgcaggcattttgcagggaacaaacgcaaacttaagatcgatttatttcttcctctcgctctccggctcggggtgaatcattacctgtgcttgtttgaattcattcgtaatagctctttcaatgcggtcacacaggtcgtgcacgtctttaatcgccacgtgagaggctacgaccaagtgaaaatcaatatactcctgcgggccggagcgtcttgtacgaaaatcgtgaatttcaataaattcctgttgaaatgtttcgataatctttaaaattgttttttcttcctcttccgacaaacgggtatcaatcagcggcgggaatgcttctttcattaacttaaacgcttcatatatgatatacaccgccagcaccatacctataataggatcaagtatgtaccactccgttaaggtaacgaccaaaaggcttgccgctacgcctaatgatgtgtacacgtcagtcagtaaatgcagggcattcgatttcattgccacggaattaaccttttcggcttctctttttacgaacttcgaaacgatcaaattaatgagagccccgcaagcatcacaacgattcccaatacgggcagatgaaccggagccgggttgaccagtttttgaacgcattcatatatcatccaaatccctgccgcaaaaatcagcatcgtctcgatggtccccgacagattctcgacttttccatgaccgtacggatgccctgtatcagccggcttttttgaaatcctgacggagataaaggcgatgaaggcggcgatcaaatctaaaaaagaatgaatggcttctgaaagtatcgcgacagatccggttattatccccaccactattttgagcatgacgaccagggaattgcttataaccgataaaaaagcgattttagaggtgttttccaccgtgatcctcctctttttgacttcttgtatttatcgtatcaaacggcattcgtgtgggtctacggcaacgtttttcacaaaagccatacatgtaactcatcataaactaagttggaaagcgacaaaacaggcgaacctttctttcagcactcaagtcccattgacaagatataaccgcttacattatagtagtttcatgaataaccactacggaggatgtttatggatgatgttctgaaagaattacagaagtttggattttctcaatatgaatgtaaagcatatatcggcttgttgaaacactcgcctgttaccggatatgaaatcagcaaaaggtcaggcgtcccccgctcaatgatctatgaggtattggggaaattagttgataaaggcgctgtccatattgtgccgtctgatccggttacatatgccccgctggccggaaaggaattaatcgaccggctccggcacgatttcgagagctcattcggctaccttgaggaaaagttattggcgctggaaagcgagcaggagatgaatgtcatccgccgcatcagcacaaatgatcatgtcatcaatgagatgaaggaaatgattgaaaaagccgaggaagagttgtggctgtctgtctgggaacagcagattccctttattcaagaagccgctaataaacgcgccgccgaacaattgcccgtcttttcgattgtgttcggccctccggaagtgaagctcggaaatacgacaaatcataatatgtctcctgaagtggcggagaaacggatgggcggaagattaacgatagctgcccgagataataaagaagtcttaatcgccaatttttctccgcagacgaatgcctgggccattaaatcagaagaccccgctctcgttctcgtggccatggaatatatgaggcacgatctgatgttcgcagagcttgtgaaagaagtcggggctgaaaaagttgaaggcctgatgaaacaaaaccattcgttatttcatgtcgtcaccggaaatcggttcatataaatgtgaaccgtattttctttgattttttcattagtcgttatcattataatctctatgaaaggagtataaaaaatgattaatacagaagtgcaaaaaaccgccgtttcccgggaaatgaacgatacgtttttacagggggtgcgggattgtgtgcctacgctgctgggctatatgagcatcggttttgctttcggcatcgtcggggttgcctctcatctaagcattcttgaaatctgtttgttatccttgtgtgtctatgccggcgccgcccaatttattatttgctcgctccttgtttccgggagtccgatttccgccattattttaacgacgtttatcgtcaatctgcgtcaccttctgctgagcctgaccatcgcgccgtatttcacgaaatactctctggcgaaaaatatcggcttcggggctctgcttactgacgaatctttcggagtagcggtgaacaaagcggctcagaacggcaggttatacgataagtggatgaacggcctcaatataaccgcttacatgtgctgggttatttcctgcgtgatgggcgggcttctcggacaatggatatctgatccttacgctctcggcctggactttgctttgcccgctatgtttgcggcgctgcttgtgctgcaattgcagtcgtccgcttcggaaaagctgaagcacagcctctccttaattctctatatgatcatttttatggtcttgttatcgtatttcgtcccgtcacacatcgcggtcatcgtctcaaccgtaattgtggcaacgatcggggtggtgacggacaaatgagcatcagcacacaaatgatctggattatactcggctgcatgattgttacacttgtgccgcgcattgttccgtttatatttgtccggaacattcagatgcctgaattggctttaaaatggctctcctttattccgctttgcattttgacggctctggtaacggaaaacatgattgtgaaaacaaacagcgctttgacctttgattggaaagcaatgatcgttctcatcccgacattgctttgcgcgatgctgacaaaaagcttatccatcacggtcatcacgggagtcgtgctgatggccgccgtcaggctgatatggtgacaatcaaaagcctccattccatagaatggaggctttacctttatgatgtcggattttcttcttccgtctctgattcctcggcttcggcgtttatgctttgctgctgttcccaatgatcccgctgcaatctttctttggcgatggtaaacatgaaattcacggcgcagcaccccttccctgttttgcttatactatgtactgtactcatttccccgtgcagtattcacaaaacataaaaaagcagcctgccgcatggagcggccggactgctttttattttcagtacgtgatcaggaagtattttttctttccgcggcgcagtacggtaaattgatcttcaatgcggtcttccgcagtcagaagatgcccgatgtccgtctggcgctcgccgttaatgtaaacagctccgttttgaatgtcttcgcgggcctgccgttttgaaggcgacagtttagattccactagcacgtctactaaagacagttcttgagagcggtctttttcaaacgaaggtacatctttaaatcctaccttgacgtcttgagcggaaagctctttaatattgccgctgaacagcgcctgggagatatgaacggcctgctcaagcgcttcacggccgtgtacaagaaccgtcacctcttcagcgagacgtttctgcgcttctcttttctcaggagctgtctccgttttttcagcataagcttcaatttcctcttttgacaagaaagtaaagtattttaagtatttgacgacgtcgcggtcatcagtattgatccagaactggtagaattcgtacggcgatgttttttctttatcaagccaaatggcgccgccttccgttttgccgaatttcgtgccgtcagcttttgtgacgagcggaatggtaagaccgaaagctttcgccccttcttcttctgattttctgatcagttcaagaccggccgtgatgttgccccactggtcactgcctccgatttggagtttgcagttcttttctctgtacagattcagaaaatcgtaggattgcaggatcatgtagctgaattccgtgtaagaaattccggtttcaattcttgagcttacagtatctttcgcaagcatgtagttaattccgaagttctttccgacgtcacggagaaattcaatgatgctcagctttccgatccaatcaaagttgttcgctatgacagcggggttttctcctgcctcgaaatctaaaaatcgggaaagctgatttttaattttttgcgaccattcgacaacgatatcctgagtatttaacgtacgctccgcttttttgccgctcggatcgccgatcagtcccgtcgcgccgcctacaagcgcaatcggatggtggcctgcaagctggaaacggcgcagtgtcaatatcggcagaaggtgtccgatgtgcaggctgtcagccgtcgggtcaaaccctgagtataaacggattttttcttcgctcagctgtttattcagtccttcttcatccgtcatttgctggattaagccgcggaatgataaatcctctaataagttagtcattttgtctgctcctttgtttatgaaaataaaaaacgccccttcgtttaaaacgaagggacgatataatcgcggtaccaccctactaataaaaacataaaaaagcttttatcactctttttgataacggaccgtgtccgttctttcactactgaaagccttggaatagctttgttcgcaaaagcggttcatgagtgtattcggcatatcttatgtgctgattttcaccggccatcagctctctggaacaatcagatatcctacttgtctcaatcaaaaccttttcgtatgaagcttactcatttttaacataaataagatacgatgtcaacgccgtctttaatcttccattgtggacaggtcgcctgccggcaggttcagctcccatgccttcagcacacgtctcatgatttttccgctccgtgttttcggaagtttatctttgaattcaatttcccgcggtgcggcatgcgcggcaagcccctgttttacaaagaggcgaatgtcctccttcagctgatcggatggctcatgcccttctctgagcgcgataaacgctttaataatttctccccggacagggtccggctttccgatgacgccggcttcggcaatcgccggatgttcaacaagtttgctttcgacttcaaacgggccgacgcgctcgccggatgtcatgatgacatcatcgactctgccttggaaccaaaaataaccgtcttcatccatataagcagaatctccggaaacataccagccgcccggcataaaataagaatcatatttctctttgttgttccaaatggaatccatcatcgacggccagccctttttaatggcgagatttcccattcggtacggcggaagctcatttccctgattgtcaacgatcgccgcttccactcccggaatcggtttccccattgagcccggcttgatctccatgcaaggataattgcagatgagctgtccgcccgtttctgtcatccaccacgtgtcgtggatgcgcttgccgaatactttatgtccccacttgatgacctcggggttcaaaggttctccgacactcaggacgtgacgaagtgaagtaaggtcaaatttggatgccatttcatctccggcgcccataagcattctgaaagccgtcggagcgctgtaccagacactgacaccgagcttctcaatcgtgccgtaccagttttccggactgaatctgccgccgacgatcacattcgccgctccgttcagccacggcgcaaatatcccgtacaccgtcccggtcacccagcccgggtccgcagtgcaccaataaatatcgtcttctttaagatcaagcacccacttgccggtctggtattgctgaatcatggcttcatgaacgtggagcacacctttgggcgttccggtagatcctgatgtgtagtgaagcaggtagccgtctcttctgtccatccattcaatatcaagtctcgtgctttctccctcagccgctttatcataatgaatgattttatctcccgcttctttgctgccgccgacaatgaaaatatgctcgaggtcgggcaggctgtccgccggaatccgttcggccagttcaggtgtcgtcacgacaacctttgcctggctgttcaacaggcggtctttgacggcgccttccataaacgcttcaaataaagggccggcgatcgcaccgattttaattgcgccgagcatgataaagtacagctccggcgaacgcggcatgaaaataaaaacgcggtcccctttttccacgtttccataccgtctcagtacatttcccgcccggttcgattcctccatcatttctttaaatgtgtatttttcattccgatttgcgtccttgtaatacagcgctactttgttttttcgaaatgattcggcatgacggtcaattgcttcgtacgccgcattcagcttccccgtctgatgccaggaaaactccgcttcgacctctttccaatcgaagctgcggtacgtttcctcataatttcgcagatgataattccccttttccgccggcaacgctttcaaattcatgcaacatcccctttgcttatctatagactaattatagtagatgttcacagttttctcaatttttaaaatataaattacaacactattgaaaacgctttatattttgttatgcttaagagagatgtgtttttattaagaaccgacaggcggtgaatcagtgaaacatcataaaacgtaccattcttcatcaattcagacagcagccggccctctattggtagaagggcccgttcctccaaaggacctagcacagtatgagtttcatgaaggcctgacagcctttcgccttcctcatgaacagcacaaagcgttaatcgagatcgccgggcttcctgaaggtcggatcattatcgccagggacggacagacgattatcggctatgtgacgtatttatatcctgatccgcttgaacggtggtctgacggcaatatggaagatctccttgagctcggggcgatcgaggtcgctcccggctacaggggctgttctgtcggaaaaacgttgctgacagtcagcatgatggatgaacagatggaacgctacatcatcatgacgacggaatattactggcattgggatttaaaaggaatgaaaaaagatgtgtgggaatacagaaagatcatggaaaagatgatgaatgccgggggtcttgtctggtttgcaacggatgaaccggaaatcagctctcatccggccaattgtctgatggcccgcatcggcaggcacgtcagtcaggagtcaattgaacagttcgacaggcttcgtttttatcagcggtttatgtattgactgacatacaaaggggataaaaagatgattgcagaacaaatcatgaaacgggacgtcatcaccgtctcaaaacacgactccattgaaacagccgtccgtaaaatgaaggtatatcatatccgccatctccctgtcatcgacgacgagctgcacgtcaccggtattgtcacagacagagacattaaacaggccggccccggcagcttcgaacaaaaggaacgcggcgcgtttctgacaaacaaagtggagaccattatgaagcggaatgtcatctgcgcccatccgcttgactttgtggaagaaatatccgcttccttttatgagcacggcatcggctgtctgccgattacggtaaatcataagctgacgggcattttaacgaaaaccgacgtgctccggactttcgtcagcctgacaggcgcggcccagccgggatcacaggtggaaatcctggtgacggatatgacaaaaagccttgctgatctcagctgcatgtgccgtgatcttcagctgcaaatcctgagtgtgctcgtctatccccatgattccgccgggtcgaacattctcgtcttccgggtgaagacgatgaatccgctcccttttatccgtgccgttcatgaagccggatacaatgtcttatggccgaaacatttgagggatcagccatgagagacagcgtttttgtttactcgccttcttatcagacgtatcaatttcatcaggatcatccgttcaatcagcagcgcgtgcttttaacatacgatctgcttcaggcggcggacgcgtttgacgatggagacatcgtcaaaccgcgcacggccactaaagaagagctggctctcgttcatacggaggattatatacaggcggtggaacttgcgggtgcgggccggctccctgccgcagaaggagaaagctacggtctcggaacggaagacacccccgtttttgccggcatgcatgaagctgcgtcgcttctggtgggcggcaccttaacggcggcagattatgtcatgacgggacaagccaggcatgcctgcaatttaggaggaggccttcaccacggcttccgcggcagggcgtcaggcttttgtatctataatgacagcgccgtggccatccaatacatccagaagaactacggggcaaaagtgttatacattgatacagacgcccaccacggcgacggcgttcaatttacgttttacgacaggtctgatgtctgcactgtttcttttcacgagaccgggcgttatttatttcccgggacgggacaagtactggaaaaaggaagcgggcaaggctacggctattcttttaacattccgctggacgctttcacagaggacgattcctttctccacgcttacaaaacggccgcctctgaaattgcggctttttttaagccggatgtgattcttacccaaaacggtgcggacgcccattattacgacccattgacacacctgtccaatacaatctccatttatcaggagatcccgcggctcgctcattcattagcccatcaatattgcagcggcagatggatcgcggtcggcggcggcggatacgatatttggagagtcgtcccgagagcatggagccgcatttggcttgagatgaaagggattgatcccggggagcgcataccgcagaaatggattgataaatggcagaagcattccccctgcacgctgcccgctttttggagtgatcctgaacaattatatcctccgattccacgcaaagaagaaatttcagaaaaaaatgcccaaaccgtggaaaaagcactttttgccatccggtctgagcagcggtataaaacaaaataaaaaacgaccttatgaggaggtcgtttttttgatcacgatttctacacggcggttttctttcatatgtccgggacttttgttgtccttcacaggtttcgtatccgcatacccggcagagataaaccgtttggcggaaaagtcttcattcgcggtaaaatactggatcacactcgccgctcttgcagacgacagctcccagttcgacgggaattgataggtggaaatccggcggctgtccgtatggccttctacctgtatgtcattcggaattgtttttaaaagcaccgcgatctgatgcagaaccggctcggcgtttttcagcacatccgcttttcccgtctgaaacagaacggcctcctgcagcacaagaaccactccgcgctcatcgcgcttcgccgtcaatttggaactcaaatgatgcgcttttatgtatgtcttcacgttttgtaacagcaaatcctgttctttattttcgtttgctttgtctgatgacgccggttcacctccgctgccgtttgtatgaatcgatgaaacggcagattgaaatttttccgcgtctatttgcgacatcgaaaaaagcaagataaagaacacgagaatgagcgtgatcaagtcagcgaacgtcaccatccatctcggtgaaccgccggaatgttccggtttgtttcttctttcaaaacgctcttttctaagcttcatggacagcgccctttttcttgttcgcaggctgtcctttacgccagtcttctcttgagctgaagacgacgagctgactttcgaggttgcggggatttttgcccgattggatgccgacaaccccttcgatcatgacctgtttgatgaaaatttcactttccgttttttcttcaagctttgccgcgattgggataaacaccaaattggcaagcagcgctccgtacagcgtcgtcaatagcgcaacggccatgttcggtccgagggtatgcgggtcatttaagtttttgagcatgagaacgagtccgacgagcgtcccgatcattccccaggcgggtgcgaaatcaccagctttttcaaaaacgcgtcttccttttctgtgtctttcttccattgcggcgatctcagaatccatcaccagccggatcgtttcctcgtcccagccgtcaatcgcaagcaaaagccctttttttaaaaacggatccttgatctcccgcgcctggtcatccagagacagcagcccctgcctgcgcgcctgctccgaaaggctgacaaatactctgacaagctctttcacattgtcatcctgacgggagaatacctgtttcagaacagaaggggttttctttaaatccctcggcggaaagctgataaagaccgccgcggcaaggccgcctgtgacgattaaaaaagaagtcagatccaaaaatgaactgattcccgccagtcccgtccctgacagaataccgattgcgacaataatacagcctaacataaagccaacgggcgtcagataatcaaaacgtttcatatcttctccttactcaagtaaaaaagcaagattccacccctcagagtgaagcttgcttttccgtttttttatgacttggttgattgtcttaattcgatgcggtgaggcaattcgacgatatgctcttcaaccggctctttgttcatcagttttgtcaaaagtctcatcgccacggcgccgatatcgtacgtaggctgcacgactgttgaaagctgagggcggaccatcaggctcaatctcgtattgtcaaaaccgataatatcaagatcatcaggtatcgaaagaccttgatcttgggccgcatggataatgccgagggccatttcatccgtcgcagaaagaatcgccgtcggtttccggtcaaggcccatcaagctttgaagcgcctccataccggaatcataagtgtaatcgccttccgctacgaattgctcgttaaacggaatcgccgcttcttcaagcgcccgtttgtacccttgcagttttttcgaacggttgatcggctcttgcatcggtccggagacgaatgcaatatcgcgatgccctttatcaatgaaaagcttaacggcatcataaatcgcctgttcataatcaatggcgacagaaggcgtctcgccctgttcttccactgatgcagccaagacgatcggcacaggagagcgcttaaattcttcgacatgctcgtccgtaatgttgccgcccataaatacgataccgtccacttgtttgccgagcatcgtatttaacagatgcagttctttctcaagattttgatccgagttgcttaagataatattatatttgtacatcgtcgcgatatcttcaattccacgcgcaagttccgagtagaaaatgcttgagatatcagggatgatgacgccgaccgttgtcgtttttttgcttgcaagccctcttgccaccgcgttcgggcggtagccgagccggtcaatggcttccaatactttttttctggtcgtcggttttacattcgggttgccgttcacgacgcgggaaacagtcgccatactgacatttgcttctctggccacatcgtatatcgtaatgttgctcactgaaaccactccttttactggatacacttatccttatctatagcataaacactttatgtaaagaaatgtcgtacgatttcgcattctgtcgtttatgattgtaagcgtaagtcagtagtgtacattatttttcattattcatcaaatttaaatatctctcatgaaattatacacgtttttcccaatgatgaaaacgttcactttcattttataattaaataaaatgaagatacgaaaaaaaagccgcgcgaggcggcctttaaagagcggaacgttgtattatgcttttactttcagcatcggctttaattcgttcagccatttctcgaattcagggatatccatctgctgcgcagagtctgaaagggcaacggaaggatcagggtgtacttcggccatcacgccgtcagcgccgatcgcaagcgccgcttttgctgtcggaagcaggagatcgcggcggcctgttgagtgtgtgacgtcaacaaacaccggcaagtgagtttcctgtttcaaaatcggcacggcagaaatgtcgagtgtgtttctcgttgccgtttcgtacgttctgattccgcgctcacaaagaatgatttggtcgtttccttgtgacatgatgtattcagctgcattgatgaactctgaaattgttgcggcaagaccgcgttttaacaataccggctttttaacggaaccggcggctttcagcaattcaaagttttgcatgttccgcgcgccgatctgaatgacgtcaatgtaatcaatcgcttgctcaatgtgggcgggcgttacgatttcactgatcaccgcgaggtcatattcatcagcgacgcgtttaagaatttgcaggccttctacgccgagaccttggaaatcatacggacttgtgcggggtttaaacgcgcccccgcgcaggattttaatgccttgttttttcgctgcggccgcgacttcggcaacctgctcatagctttctacggcacaaggtccgacgatgaatctctgatcgccgtcaccgattttttcacctttaatgtcaacgatcgtatcttctgcttttttcttccgggagacgagcaacgctttgctgtgatcctcttcttgaagttcaagtccggctttgaaaatttctttgaaaatatgctggatcgttgagttttcaaatgggccgtcattgctttcaataatgcggttaagcattgtacgctctctgacagggtcaaatcggttgacaccctgtgcttcctttgctttaccgatttcttttacaacggctccgcgttcattgattaatttaaggatttctaagtttagtgcgtctgcctgctgtcttagactctctaattccttgttgctcatctttttcatcccttctatgctatgttttattttaatggttaacatgcatcttactacagttatgcgaaaataggaatatgaaataataaattttttcacattcgactttatcacaaaaacgcttttaagcttttatgcgttgaagcagtatatattgatatcctacatgatccggctgaaatgatcaatagtttttttcaaaaaaaaaccgccggtatcaaccggcggccagcaattatgaaaggtgctgctctattgcgttttttgtgatttgtgaatgagacgcgtgccatttcacttcgccgtttgtaataacgaatacttgcgggctttcatgtttcacgccgtatgcctcggcgatatagtttgaaagcggccggctgtcctgcacatgcaggtaataagaaggtacttctgaatgctccgatgcaaaggcgtcaaactcctgaaacgcggcttggctgatcgggcaggttgtgctgtgttttaaaaacacgagcgtgttttctttctcagcggcatttttgaactcttcttcagacgatatcagctgttttgtcatgtcggttatctctccttattgaagatcagcgatttgcctgaccggctttttccccggcgtcttccgcttcggccttgatgctttgggccgtgtcctgcatttcgcttctcgtctcttcggctttctcggttagtgtgctcttagaacggtcttttaaatccttcactttattcataatctgacctgactgatcagctaccagctgggtgatattagatgttttgtccttggcgatgctgacatattgagagcctttttctttcgcgtcggccgtcattctgtccgtcttatcctttaacgcagaagcctgactgccgagatcgtcgcgcagctccttacctgatttaggcgccagaaacaacgccgttgtcgcgccgataattcccccgatcagcgttccgattaaaaaatccttactattgattccatctttgctcattatgattcctccttagtggatttttcttatgattaaagcgatgtttttttcttttgcttccacttgtcccatatttccatagcggcctggctccaggtgacaacctgactgatcttatcctgattctctcttacagaggccgtaacagaacctgctgcctgctttatggatgtattaaactgctggacggaagttcccacttcctggacagcatggacaaccgtatttaatttctctgatttttcctgaatgtcttccgcgagacggtttgtcttatgtaacagctcggttgtctctgcggtaatgcctttcatctgcccttcaaggccgtctaaagtcgaggctacgtttgttaaagtcatctgcacggactttaatgttttggacagatagatgacgaggatgagaaatgcaacggcaatgagtgcgacgcttaagtaaagaatgatgatcatctaatacctccttaatgcaggatatagtggtatatacccaattcttaaaatgataaacatatatgaaaggtctgtatgtatactatttctccgtttatcggtaaatccctttgcagcacgcgcaaaaaagcagtgagagccccactgctttttcgttacgctatgacgttttcataggccctcatatatttttgaatgtctccggcgcccatgaagatcagtactgcgccttcatgcgcttttaacacggaagtgtcattttcttcaatgagttctgcgttatcgattttttcctgaagatccgtgatcgtgagcttgccgacgttctcacgggcagagccgaaaatgtcgcacagatacacgcggtcggccgcgcttaagctttctgcgaattcatccaggaatgattgcgtccgtgtaaacgtatgcggctgaaataccgcgatgatttcacgttcgggatatttttggcgcgccgcctcaatcgtgactttgatttcagtcggatggtgggcgtagtcgtcgatcagtacctggctgccgatcactttttcattgaatctgcgtttgacgccgccgaatgattcaagtccgagcttaatcatgttcacgtctatttcttcatagtggcagagcgcaatgaccgctaaggaattgaggacattatgatggccgtatgccgggatgtagaacgtatcgtaaaacgtattgcggacaaagacgtcaaatgtcgtgccttccgtattttttacgatgtttctcgcttgaaaatcgttttcttctcccgtgccgtaataaacgacaggcacattggcgtgaattttcggcaggtactcgtcatcaccgcaggcaatgatgcctttgttgacttgaagcgccatgttttggaaagcatcaaacacatcgtcaatgttggcgaaataatcagggtggtcaaaatcaatattcgtcataatcgcataatcaggctgatagcttaagaaatgacggcggtactcgcaagcttcaaatacaaagtattcgctgctttcatttcctctgcccgttccgtccccgataagaaacgaagtcggcttcgcctgctgcatcacgtgtgccaagaggcccgttgtggacgtcttgccgtgtgcgcccgttaccgcgacacttgtgtattttttcatatattcagctaaaaatttatgatatctgatgacaggaatcccttcatcgagcgcctttgcaatttccggatgagaatcagggaatgcgtttccggcgattaccgttaagccgggtttgatgttatcggcgctgaacggatagatcgggatatttcttttttcaagggcagcctgagtgaaaatctgcttctcgatatccgatccctgcacctgataccccgtatcatgcaggatttgagcaagcgggctcatacctgtcccttttattccaacaaaatgataaacagtcataatcgtacctccaacaaacgtctatctgttccccagtatatgacgctcatttcattttgcgaccgcagcgggcgaaaagcccgcacagcggcgcttccatttatttttacgttatcgtcagtatctgtaactttctttttgattaaacctgccgcatgatatttcagcgcgtgacagtgatgcagttttgatggtccatccactatcataccatgtttgtgagaaaaatgaacgatattcttattcttgagaaatgtcagcggccgtaatcagcacttcacgcggtttgctgcccttcgcttctgagatcatgccttcggcttccatcatgtcaatcagcctcgcggcgcggttataaccgattctgaaccttctttgaaggcttgaggtgctggcgctgttttgctccacgacgaattggcacgcctcaggaaacagttcgtcttcttccttaagggcggttccctgcctgatcagttcttcctgttcaaacaaataagaaggcggcagctgctttctgacatgagagacgacgcggtcaatctctctgtcggatacaaagttgccctgcaggcgcaccggttttccggtaccgttttcccagtacagcatgtcgccttttccgagcagcttttccgctcccgccatgtcgatgatcgttctggaatctacctggcttgagacggagaatgcaatcctcgtcggtatgttcgccttgatcattccggtaatgacatcgacagacggacgctgtgtcgcgacaagcagatgaatgccgcaggctctcgctttctgcgcgattctggcgatgctttcttccacatcgttcggcgcgaccatcattaaatcggcaagctcatcaatgaccactacgaggtaagggagcttttcgcctgtcttatgatcggccgttaattcattaaagcgtccgatatctctcacacccgaatgggcaaacagttcataccgccgttccatctcttccacaacccattttaacgcggcggtcgcggctttggcgtccgtgatgacggggctgaccaaatgcggaatttggttataaggcgcaagctcgaccattttcggatcaatcagaagcattttgacatcactcggatccgccttataaagcagactgaccaaaatggtattgatgcagacgctttttcccgatcctgtcgcacccgctatcaacccgtgcggcatctttttcaaatcaatgacgaccgggtttccggaaatatcgacaccgagcgcggctgtaagcggagacggattcgtcctgaaagcggcgcttctgatcatctgccttaaatcgacgactttgcttacgcggttcggaacttcaatgccgatcgtgtttttaccggggatcggcgcctcaatccgaatatccttggcagacaggctcagtttaatatcatctgctaagtttgtaattttgtttactttcactccgggctcaggatgcacttcaaaacgtgtgacggacgggccttgtgtgacatgaacgacttgggcgcgcacattaaagtttttcagtgtaacgtttaaaagctcgcgctgttcttcaatccacgattggtcgtcatgtctttgcgccggcggtacgtccagaagcgacagattcggaaagacatagctcgctccgccctctggcgtcttcgtctgcttgtgtttatcgcttttaagcatcatgacgttaaacggaacattgcgctctttcggctgctccgcttttctcacagtctgaggctgtccgtgatgctccgttttttcttcggcaggccgggatggggcatcggtcgtctcaatgcttacaggttcaggctcggggtctgaatgccgctctgcttcattgtactcaggctgagagtctgcttcctgtttcgcgtcgggttcagctgattcgggcttgtcttcagactgcggctgaatttcctcgtatccgggttctgtgtatgtatacaccggttcttctgcggtttcaaaaggcggtgctttttccggctcaggctcctgatgttccccctccggcgccgcttgttcctctgtgttttcagccgttcgggatgcttcagactcaggctctcttataggctgcgggcgggtttgttcatgctcttgttcttctgtaaagccggcagactccgcgctttcggtgtgctccagctcttcagcctgctgcggttctggtgctgcaaacacttgctcttttgcattctcagcctccgtgtgaagctcctcttttttaacggccggaatttcttccgtttcttgtttcgcaaacggttctggccggtcattcgtctgttttgttataccggatgttgtgaagacgggctctttttccgtttcctgaccggattttggcggaacaaattgctcctctgacagcaatgttacgttctcttcacgccgcttttcggaaataggcgcttttttgatgctgtgctgagattgaaagccgtaaaccggtgaaggaatggatgacggtttaaagggctttttcaccgtatcaggctctttatgtgtatgctgtttccgctccgtttgctccttcccggcggcataaccccgggacggctggcggcgttcgtgcctttcccgctgtctttggttttgctccgttcgcttatagccgtccggaacgaccgggaagcggaaattccctttcggatattcgtaatatattttagaatcttccatgcgcgttaatttgccttctggctgatccggtatttgctgtttctggatttgggcatgcgtgttcggttcacgttcatgctcttcttctttttcacctaaaaataagtcaaaaaatttattcagccaactcatgtttaatcactctctaactccctttttagtagtctgggacgatatttagtataccattgccgggcggctcagaaaagattaagctcccaactgaagaaagccgttaagcaggcctgcttaacggctttctctcacatcattcgattctgtgcgcttatttatgggagttagaattgaaatgcttcgccggcctcgcggctgtcttcaagaacaagaatccctttttccgccggcgcatccggcaaagcgagttctttcgcggagcagatcatgccgcttgacggaacgcctcttaattcagcgtctttaatcacaagtccgctcggcattaccgcaccgactttagcgacgacgactttttgccctttgtccacgttcggcgcgccgcaaacgatttgaagggtttcctctccgacattcacttggcagatattcagtttatccgcattcggatgtttttctttcgattcaacgtgaccgacaacaaatttcggagaaaggtcaaccgtcagcgtttctgaaacgccgtttctgttcagtatttcattcacatcctgtacgaaagtctcagacaaagcgacggggccgttgtcttcaatctgtaagtaagaagacacgttaaaaatgttaaagcccgtcgtttcttttgtttctttgttaaagattctgacgacatcgccttctctttcatagccgatttcttcgcgtgctgcatctttaagagagatcagaagcgtatctcccacaccttctttattgtaaaaagcgttcataagaaaaatcctttctaatcctttttcggccggcttttcgccatgataaacacaggttccagtctgccttcattatacagaaatgaaagggccgtaatcggcaccgtgccgcttgcaaagaagctcatggacatttgccctaaaatatcataacccgattcatttcgaatgtcagcaagtattaatacatcctgatgcgggacggaaatcgccaattcgccttcagcggcctgcttatattcatgaagaatcgaatcattgagaatccggctggcgtcatagccgtcattcgccctgaaaaaataaaaataattatccgcaaccgtatcctgtttcacgaccgaaggaagagagcggagattgaatgacgccgtctccctgatccgttcttttgtccagttttctttctcgagcatacggctgtcaattaggcggtacgtcttgccgaggtcaagcgcgtagtagattctcgtttcggccgtatggtcatcatacacgagcggaatgccgtcgctcgtttgatcgggaaatgacgtggagcggatgaccggatagattccggcttcctttccggacatctcctgtccgcttccttccatcgcctccatcgcttctgacacatagtagacgatttcgtcgatcgcttcttcttttttcgtctcccacttcgcaatgatcggcgggagctccaatgtgatgccttttttggtcgtttgatcctcaacacggagggtgtctttttctctgtcaaaaaagaaggatcggttctcgtgctgcaggcgctgttttaataaatccgccagcttccttgacgtcattttcaaagcccgtggcctcctttatgctttagcaagggaatcggttaaaaattgctcaatttcttcttttgttttacggtctttgctgacgaagcggttcacttcttttcctccgttaaacacaacaaagctcggaatgccgtaaatttcccattccgcgcatgtatcaataaattgatcgcggtctacgtagtaataagtgaattcaggaaagtccgcttccagctcagggagaaacggctccacaaagcggcagtccgggcaccaatccgctgaaaacataaataccgcccaatcgtcttgtaccgctttttgcaattcttccgtgctttcaatctttttcattgtcattcctccatctggattatgagttttttatatgctgatgtttgtccaattggatcataccagactgtttacggcaagaccaactatatgcaatatcattatcatatttcatttgcattatcaagcaagtttcgtttaccattttgcttgtagccgtacgaaaatctgaatatgtacataaggaggggcaaaagatgcagtttgtcgtgtatttagcgggtgaaatccacagtgattggcgggatgaaatcaaacaaaaagcaaaagcgctgaacctgccgattacgtttgtcggtccgatggaaaaccatgaacgctcagacaatatcggagaagagattatgggcgtgcagcccgattctgttttaaaagacgccagagcttctgatatcaacaatttccgtacagaggtgctgatggaaaaagccgattttgtgatcgccctgtttggcgagaaatataaacagtggaataccgcgatggatgcttcttatgccatcgcaaaaggaaagccgctcattctcatccgtccgaaagaacttcatcatccgctgaaagagctttccggaaaagcgaatatcacggtcgaaaccgtcaatcaagcgatgaaagcactctcttatttatttgaaacagaataagcaggccgcttttatgcggtcctgcttacctacactcaccacttcagtattaatcagttcaagaggaaagtttatatttgtcttttttgtcataatcataccttcttgcagaacaaataaaaatgcaaatgactcgactttgtgaaatcgctgctcctctcaatgcttgcagcatgtttttgatttaaaaacgtttatcattgcaataaaggttcgaaggttgtttatctggatcggaaccattttgataataatattgaaaaataatatgtgttacctaattctatttacaatacgctttacacttatattcacaacaaagaactgtctcgatcatgcggcttaaaacagaatgtaaaaacagcagtcaataagtattcaaagggacttattgactgcttattttttttacacattttctctgatcgtttcgaccgtctgtttgtcactcgccatgaccagcttaatgagcatttctttcgccgcggcataatcatcgacatggatgatagcggcatttgtatgaatgtatcttgaacaaatgccgatgacggcagacggaaccccgctgtttgatatgtggacgcgtccggcatccgttcctccgcctgaagcgaaatattgataagggatattgtgcgtttccgccatatcaaggacgaactctctcatcccgcggtgcatgaccgtcgttctgtcgagaatgcggagcagcaccccctcgccgagacggccgaacagctccttatcgccgctcatatcatttgccgggctggcatcaagcgcgaagaagagatcaggctgaatcatgttggccgctgtctgcgcccctctcaagccgacttcctcctgaacggtggccccggcgtacagattgttcggcaggtcttttccgtgcagctcttttaatagttcaatgcttaacccgcagccgtagcggttatcccacgctttggacaatattttcttctcgttggccatcggggtgaacgggcagaccggcacgacctgctgtcccggtctgatccccattttgaccgcgtcctctctgtcatcggcaccgatatcaatcatcatatttttgatctccatcggctttgcgcgctgggcatccgttaaaatgtggggcgggatgcttgagatgacgccgataatcggtccgttatccgtctgcacctcgacacgctgggcaagcagcacctggctccaccagccgccgagcgtctgaaatctcagcatgccgttatccgtaatctgtgtcaccataaacccgacttcatccatatgcccggctaccataacggtcggcgcatcttcagcgccgcgccttactccgaaaacacttccgagtctgtcctgcacgatgtcatccgcatatttcgcaagctcccgtttcataaaagagcggacctgatgttcatttcccggtgcgccgggaagctgcgtcagcgtccggaaaagcgttttcgtttcctcattcatattttcccctcatttctatgtaatgcttttattttattagaaaaacaaccgttttccaagcgctcagattgaatgggctgtaaaaccgccgctttacttaacaccgtctggcatcttctgtataataaaaactacgacataattggaggtgcttcatattgaaattacgtcattttctcttaggtgcaggagtcggattatgcgctgccatcgcagtgaaaaagtatgcgatgaaaccttatatctcttcagaaaaagcgctccgtatcgtgaaagcggcttttaaacagcgcgggccgatagacggatcatggatttacacagagccggagccctaccaggtaaacggagaaaccatccaggtatacaaaaccggcgtgacacgttcggcattcggcgaactggagcaatatgaagttatggtcaatgcaaaaacaggccagattgtcgatgtcattgattctgtcgcctcataattcggacaagcaaaaaataaagcccaaaaccatcagcgttttgggctttattcggttacatcggccgaattcgtttatatacggggttccacatcgcgtcctgaaccgcttggatcagatcctcgggttccgtttccgctacaccgtcctgaatcgcagctttagctacagctaccgccacggttgccgataccgtcctgagatcctccactttcggaagcatcggcgcgcccggcttgccgacgtccaccataccggcgatggcattcgcgcaggcaacgaacatattgtccgtaatgagccttgcttttgtcacaatcgttccgagcccgagtcccgggaatacgagcgcgttgttcgcctgtccgatatggtaggtaacgccgttatacgcaacaggcgggaacggacttcccgttgtgacaagcgcgcggccttccgtccatttaattaaatcttcaggttttgcttctgataatgtcgtcgggtttgacataggcaaaatagccggccgtttgacatgtgaggccatttctttgacgatttcttccgtaaatgcgcctgaaacggtagatgtgccgatcaggatcgtcggcttggcctgtcgcaccgtctccgccagatcaattgatccgccttcaccgctgcggccgtactctttcacttcatcagcagggcgggcgtacggaacctgaaaatcacgcaagtccttcatatcatccgtcaacaatccgtttctgtcgatacaccaaaagcggctgtatgattcttcttcgcttaatccgttatgcaccatagcttcgcgcagctgctcagcaattccgataccggccgttcccgcgccgaagacgacgactttatgctcttttaaaggcacttttgatgctttcgcacacgctaaaacagctgcaagcgacaccgcgcctgttccttgaatgtcatcgttaaacgtacagactttatctttataccgttttaatatgccgcgggcgttagccgtgccgaaatcctcccaatgaagcagcgcattcgggaatgtttcccgggcaagcgagacatactcatcaataaagcggtcatatttctcgccgcgcactcttgaatgttggtttccgacatacagcgggtcatttaagaggctttcttgatttgtccccgcgtccaaaacgaccgcaagcactcgtgacggatcaattccggcggccgccgtatacaccgcgagttttccgacagaaatggcgatgccgccgacgccccagtcaccgattcccagaatgccctccgcatctgtcgcaacgatcaagtcaatgttttcattttttccgaactgctgaaatgcggcgcgcattccttcagggtcatctattgacaaatacagaccgcggggttttctgtactcgtggctgtaacgctggatcgcggtgccgacggtcggcgtatatacgatcggcagcatttcgcctaaatgatcatttaacagcctgtaaaataatgtttcattccgatcatggagagcggtcaagtacacatttttgctcagctcatcaggctgcgaactgaattgttcgtaggcccgcctcgcctgctcttcgattgtcaatactttcggcggcagaaatccctcgagcccgagttcctttctttcctcctgtgtaaaggccacccctttatttaaaaaaggcgtagaaagcacttctaatccgcgcagagttgttttgatttctccatctttcgtcacttgaaattgattcacctgtctcttcctttcaaagcaatttgtcttaggtttgcttttattcccgaaattcatacaggtaaatcatcgatccgcttattttctctcccgtttgacagatgcagccacttcgccgtcttctccccattttaccgctctgtaaatcgcgtcgtgatagaaaatcagccaggcgcctttttctgccgcgaacgtctgccatttctgcttttgcggaatggaggtcatcggataatcatcataggccagcacccataacggatttttatgcgcattcgtcggcatcaggtcggcaaaatgcacagccgtctccccgccgtcttctaagacgatgacactgtggccgtcgctgtggcctccggtgtggtgcatcgtaatgccttctgtcagctgatactcgttctcaaaggtttcgacctgatcttgtaccgcctcccaattttctctccaatatgtatttttcgatctgatattagggtttctcatttcgcgccactctgttgcagaagtgataatgcgggcattcgggaaaacagagacaagctcctctccgctgtattccgtcaagccgcatgcatggtcaaaatgaagatgggtcatcgccgcaatatgaatgtcctcacaggaaagcccgagttcacgaagagagtgttttaaattggattcctgtgttacaccgtaattccttttttgtttatcagaaaatttccctctgccgatacccgcgtcaaccaatatattcaggccgtttgttctgatcagaatcgggtctgttcttaattcaatctggtttttgtcatttacggggtattttctcgaccataaaggcttcgggacaacgccgaacatcgctccgccgtccatatgtgttacaccgccgtccagccatgttaatgaaatattcccaatattcaatgtctccatcttgatccctcctgatataatggtagcaaatggcggcataaaaaaacagactcccgcatcagagtctgtcttttgttctccattcaacttcggcccggtaaatcggctggccgagtgcggagaatttttcttcgtattctgtcataatattgcccttcggatcgctgttgtgcagatctaggctgacttctgtcagaagcaggccgtattcggaaaagcttttcagagagtattcgaataaaccgcggttatcggttttgaaatgaatctcacctgtttcgcccatcacttcttcgtattttttcaagaacgttttaaatgttaaacggcgcttttcgtgacggtttttcggccacgggtcagaaaagtttaaataaacgcgcttgatttctccccgttcaaatacgtcattcagtgtttccgcgtctatatttaacaaacggacattatgagccccgctgtcctttactttttggacggcagtgacgatgacgcttttaaacagctcaattccgatatagttgatatccggattctgcttggccattcctgaaatgaactgcccttttcccgtaccgacttcaatatggatcgggttgtcattgccaaagaccgtattccaccgccctttatactgggccggatcactgatggcgatgtcagcgttttctgccagaaaatcattcgcccaaggtttatggcgcattctcatatgattgacacctctatctataatttcgagtaacaacataccatgaaacataaagagccgcaagcgccttttaaaggcgccggccgcataaaaaaagaggctccccggtccggaacactcatgtgatgcataaaaccgcaccgctttgcacaatgtatgacacagaaaggatgtgtatatgaatcatgggcttaacaagcgaacatcaggtccggttattaaaggacatattggccgaccatcaattggattgctgcggcacggttgccgagtatgaacagctggagcgcgtcatcaaatcactgatggccaacaccgggcttgattcaaatataaaaaacgtgctcgaggatgtctaccgctacagccagtccggcatcacggccgattccatcgacacgcatattcaggagcaccaaaaccatttgtcccaatgggtggagcagatggattcgtactcctgactacttgacaatccgcttcatcagggcatgaagctcttccatggcatcatgatacgctttgtcgtttccttttgatttgtgccaggcgatgaaggtgatggtctccgataacatgtaccacgccatccgcagccgaagcccttccgtgagcttcatgccgtacatcccaagccagctgtcccacgctggctcttcgacgtaatgatacaataaagggccgagatccatggccggatcggctatcatggcgccgtcccaatctattaaatacagctggttgtcttcagacagaagccagttattatgattcacatcacaatggcaaacgactttttcaccgaattgcacctgatccacatgagcttccaaataagcaaggccttcctgaataagcggcgaaaattgccgcacggcaaagacggcctgcttcagctgcgacaaaagggcgcccggatcaagcggttcttttcccaatcttttcagcatgtcgagcaaagcttttgatgtgtggattttgcggagcagctcagccaccgggcgtccgctcatatcctttgccttcagctccctgcccgccatccaatgctgagccgtaatgacgtctccgttttccatccgttttgtccaaaccagcttcggaacaatgccttcggcggataacacggctaaaaagggcgagctattacgttttaaaaaaagctgttggccgttatgtttcgcataatatgcatctcctgtagctcctccggcggggaagatctcccaatcgctacctagtaattgtcccaaccagttcatatcaatgttcaacccatcatttcttaaaatattttagaataggcctccagcctttctctattggcggagcggcctgtcataaacaatttcatgagaataaaaaagacagctattgagagtctcatatgctaatcaatagccgtcctataaattttagcgctacagcacaaacttcgtcaagcaaaactagcaagaacacctgtgaattctgaagatttatgccgcgaaccgctctgttgccgtgaaacaattgacgggtttcatttgtttattatgtttttattttcaatggcgcaccgcccggcataagccgaaacggcgtcgttccgatcagctcgccgtcagcgtgaaacggaattttcccatctgtttcaaaaacgaattccttcccctttatcatcgtcactccgtccattttgatatgccggccgaagctcatcgcccataaaaaacgatacagcgaaaaaaaggacaggttttctgcaatgacaatatcaaaatagttttgacggggatttgctgaaggcgccgctttcatgccgcctccgtaataagggtgattagccgcaataacaaaccagacattgcggaattcacgtctctggccgtctgccgtgcaaacaaatctgaacggctgaaaccccgaggccgtatgtaaatgcgcgagcgggtaaatcacaaagccgagacgcaaaaaccgaagaacgcgcgaaaacggaaaattcgcggctgccttcaaaactgaggcatcgaagccgacagacaggtggttaataaaatagagtgattgcgctttgtcatgaaaaaagttgatgtttcccgcaaaaaatttccgtgtgagcgggcggtgcagacttttgatttcttggaggagcgccgacttcttaataccgagccctttggaaaagtcattgtacgaaccggcgggcacaaaggtcagctcaatctgatccgttcctttcagtccgttaatgacttcatgcatcgtcccgtcaccgccgatgacgaacagccgcttaagcttatgatcctgcatcattgaaatctgtcttgccagcacctccgcatgtccgggatgcccggtcaaaaaagagcggtggctgaccccgcgcctggtcagctctttttgaactgatttccagacacgccggccccgcccgcctcctgagaccggattaataataaaaaaccattgactcatcgtttgttttcacctgcttcatagatgaagagacagccggcaaacgtccgctttaatcaagccattcctgtctccggcttgaatcgctcaagccgtaagacaaaagagccttcgccgccttcagctggtggtgcttgatcggcgccgtatttttctgctgcttttccagccaccctgccgcagtccgtttatcagctatttccagcccgtacggcggctccgggtaatcaatataagacgttctgctgagcaaaagcttccgcacgggaatgtcggcctgcttttcttttacgatttgcgaaacgaccgagcccgtccggtgcaggctgagagacggattcaatacttggcgcgtgctgccggagcctctttcttcccaaaaacggtgttttgatccgatatatacactgtcctcttccgcttccataaaagcggcgcagaaaatctccagcggcgagatgatgataatgctcagttcgacggacgcctgctgaatttgcagaaccggatgatacatcacaaaataggaatcgggcagtttttgagccagcatttttaacatcctgtcccttttgaccgcctgcgaaagctcagacttttgagaaagcgtggagctcgcccattttaattgaaagtcatacagctgatctttgaaaaaaggcgcgagctcagacttttgagacggaagattcccgaacagcgcctcttctccctccggttcatcaaaccattggtgcctcttttcatttatatcggccgtattttcttcttttctcttttttaaggaaaattttttcctggccggcgcttgatcggtttccccgccggcagccgtttccgtttcttccgttatccggtcaaacgcttcaagaagcgcctcccagcgttctttcttcagccggataaactggttcatataatggtatggatcaagttcatatctggatatgcagtcgtgaattttgatgatctgtgccatgtgatttctccactccgaatatttgtttatgtcaattgaaactgtgcgatttcttcgtatttaggcgaccggtcaagatgggtctgaaacagggaaaacctgctgacggcactttgcaccctgccgctttcaaacggcacatcgtcagaaaacggccggtctcccgcccacttccgcgccatcgtcatatgagggtgatacggccgtttttccacttgaaaaccggctttcaaaacagcctgttttgttttttcccgcaaatcaaagagcagttcattccgttcgggctcaaggtgaagcactctcggctgtctgcggtcgccgaaaatatccagatgctgaaactgtacggtaaacggctgcgctgccgacgcagcatctgcgagcagagacgataatttcgcaagccgttcttcatccgcggctccgagaaaaatgagcgtaatatgatagtcatgcgggtgcacccattttttgaatgataacgccggctcctttttggctgcttcccaaatcggttcagcaatgtcagccggaatcggaatgccgataaaataatgcggcaatgaagctttcatacgaggatctccccctctttggttatggtgttattataaaacggataagcggagaggagaaccctgtccgctcattatgataggatattatgtaccgaacgttttatacagaaaggaatgagccggccttgaaaatcgtaaacagcacggcggagctgatcggcggcacaccgatcgtaaagctcaatcgccttcagccagaacatgcagcacaggtctatttaaaattagaatcgtttaacccgagcggcagtgtcaaagacagagcggcttacaatatgatcattgaagcggaaaacagcgggcatttaaaacccggctctgtcatcatcgaaccgacaagcggcaacacaggcatcggcctggcgatgaacgcggcggcgcgcggctacaaggcaatcctcgtcatgcctgacacgatgacgaaagaacgcatcaacctcctgaaagcgtacggcgcggaggttgtgttaacaccgggggcggaaagaatgcccggcagcatcaaaaaagcgaaagaactcgccgaacagattccgggaagttttatcccgatgcaattcgataacggcgcaaatccagatgcccaccgaaaaacgaccgccattgaaatctatcaggccgttcagcagctcaacagaccgctcggtgcttttgtggcaacggcgggaacgggcgggaccattaccggaaccggagaaacgctgaaagagcttttcccggatatgattgttcatgtcgccgagcctgcgggatctcccgtcctgtctggcggaaaacccggcgctcataagcttgtcgggacaagccccggatttattcccggcatactgaatcaggacgtttacgatgaaatcatgaaaatatctgatgaagatgcgtatacgacaacacgtcgtctggcccgggaagaaggcatactcgtcggcccgtcttcaggcgccgcctgcttcgccgccattgaaaccgccaaacgcctccctcccgaacagatcgtcatctgtatgacggccgatacgggagaacgttatttatccacggatttatggtcatttgaatgataaaaagggatgccgctttcggcgtccctttttattatcacttggcaagttcataaatggcttcggcatataaagccgttgacctgagaaggtcatcgatttcaatgtactcatccttttgatgcgcgctgtcaggccggccggggaacagcggaccgaacgcgacgcccgccgaaagggatctcgcatacgttcctccgccgattgaaatcagatccgctttctttcccgtctgtccttcgtaaaccttttgaagcgtctttacgagcggatgatcggcagaaacgtggtgcggtttgctgtctttaaattcttcaagccggaattcttcagcagacgtaaaagcatcacggatgactttgctgtctgaagtgacgggataacggatgttgatgccgagttctccatcctcaccctttctgtatgtaaaggtgccgacattcaatgtaagctctccgctgatgtcatccctgcaatcaattttcagctttttgcctcgtgtatcatttaaaaaatagtcactgacggttttgacaaagtgctttccggctccatccagctctgttccgttaaggcattcagcaagctttaagccggcattgataccattatccggttccatcgcgtggcatgatttcccgtatacccgaagcgtcagttttccattttccgaaactgcttcaccttgtgtttttgactgctcaagccatttgctgaaatatgcgtgcacggcatcaataccgttcccttcaataaccgcttcagccgcatccggcaccatgttcaagcgcagtcctgaacggaatgacagaagcacgttttttgcgtctttgtcagaagcgttttttacaatgcgcagtgacgcatctataattcctttttccgcgttaatgatcggaaaatctgcgtcaggagcaaagccgatgtcaggcattttttcgtgtttgaagtagtgatccacgcatctccaatcactttcttcatccgttccgatgatgattctcacgcgtttggataaaggaagctgcatgtctttgacgattttcagcgcataaaacgccgccattgtcggccctttatcatcaatggcgcctctggcatatatccggccgtccctgatatcggctgaaaacggatcgctcgtccagccgtctccgggcggaacgacatcgacgtggcacaaaacaccgacgatttcgtcacccgttccccattcaatatggcccgcatagccgtcaagattctttacggtgaagccttcttttttaccgaattccagcagtgacgccaggctggcattgacgccttctccaaacggccggccgggaccggctgttgattcgtccattacgctgttgatctgcaaaaacttctgcgtgtcacggatcagatcttctttgtttctgatgacttcaacttcccagttcatcacaaatcccctttcttgataaagacttgcaaaatgtcgataaaacgaataatatagatgatgttttgaaaaaatgttcgtcattggaggtacttatgtttcatctcgacaagcatcaaacgacaataaaaagagaaattaccgcgggattgaccacctttttcacaatggtgtatatcattgtcgtcaatccggtgatcctttccaatgcgggaattccgtttgaccaggtgttcaccgcgacgattatcgcttccattgtcggaactttatggatggctctcgctgcgaattttccgatcgccattgcccccggcatgggcttaaacgcgtatctcgcctttcacgttgtcggcacaggcagcggcattacgtatcagacggctttcagcgccgtttttatcgcgggagtcatctttattattttatcgttaacgcctttaagaaaacaacttatagaagcgattccggacaatttaaaatacggaattacgaccggcatcggcttatttatcgcttttatcggcttacgccaatccggaatcatcacggctgataaatccaatctggtcgcactcggcgatcttcattcgcccgccgtcattttaacgcttatcggacttatcatcagtatcgtgctgatggtgctgaatgtaaacggcgctctgttcatcggaatggcgctgaccgccgtcattgcctttttgaccggacagatccattttgcgaaagggttcatttcatttccgcgcctgccggaggggcttttaatcacaaatccgttcggtgccctcggggatgtcgtgcatcacggtctgtacgccgttgtgttttcttttcttctcgttacgatttttgacacgaccggcaccatgatcggtgtcgctgaacaagcgggattgatcaaaaacaatcagctgccgaatgccagaagagcgctgttggctgattcaacggctacgacggtgggaagcatcttcggcaccagcccgacgaccgcgttcgttgaatcttcagcaggtgtggccgccggcggaagaacaggtctgacggcgctgacgattgccgttatgtttgccgtttccatgtttttcagcccgcttgtcagcgtcttatcggaagtgtccgcgattacgtcaccggctctgattattgtcggcagcctgatgatgggtgctgtgtcgaatatccgctggaatgagcttgacgaagcgttcccggcctttctcgtcattttggcgatgcctttaacgtccagtatttcaaccggaatcgcactcggcttcatttcatatccgcttgttaaagcagctaagaaaaaatggcgcgaaatccatcctctagtcctcatcttcgccgtgctgttttttattcagctttttattttgaacggacattaagaaaaatccctttccttttcggaaagggatttttacatataaagaacggaaagaatcgcggcaatgagacaccaggcggaacagatgatttgaatgacggttaatgcactgtttcgcgcccggaaatagtcatcactgtctctcttgataccgcttaaaaccggtttatccgtgatccggtcaaataaaagtgacgcggcatagcggctgacgatcgcaaataaaataaggactgccggcttcactaagagcggaagaacgagaataagagccgtaaaagccgcggttaaaaggtaaagctgccggagatacccgccgtttcggatcagcactttaaaaaacaattctttccacgccgtatacgccgaccgttttgtaaagatgtgctttgagccgggatataaaaacggcttgctccgccctttatttttaccattcgggagctgcacatcatggctgagcatcaaaactgaggcggcgagtgaaagcttccgcctgttctcctcaagcacttcttcctcaaaggctgataatgtctccgtccctttccaagtcaaaaaagcggaacagatgaacaatatacatcccgccggccaaagccaataccattcggcggcaaaggtgatcataaaaaacgcacccgccgtcagaaccatcactttcagccagcccgccgcctgattcccgaatgtccgcctgctgttttttctgtgccggtgcaccgctaatatcgcggtatggaagccgaacagacagcaaaacatacctgaatatgccggtaaggtacagtcaccgtactggcgccataagggaaataacaatacggcaagcgcaccccatttgataagggaaaggaacatcgaatacaaaagcgcgtaccgtttcagcttttgcatcagatgttttgcatgcaccaaaaacacgtgatccgcttccagcaaaaaggtatgaataaaacccgtgcacaacagcaaggcactgaatacatacagccagccccatcctaatactcctgccgctccattaagaagccccctgccgttcagccattcagcatattgataaacggcaaatgcggcagcgggaagaacgatgtacagcgcgaccgtccaatcaatgaccgtctgaaacaccttccattgataccgccaataatgaaacagcctttgaaaaaacaaagcccgcccggtcatcgctgactgctccgaaccgctgaataaaagcaatccagcagtgaacggctccccgttttttcctgaagctcctctaacgtgccttgaagaagcagagcgccctgatccagcaaataaaaccggtcgcagattttttccgccgtatccagaacatgcgtgcacatcaaaattcccgcgcccctttctttctcagcaatcagcatgtcggtaaacagcttcgttgagatcggatcaagtccgataaaaggctcatcaatgatgtaaatatccggcttcgccaaaaatgcctgtataagcatcatcttttgctgcatcccttttgaaaaaccggaaggcaaatcatgttttacagacgtcagcgaaaactcttcaagcagccgccctgcccgctcacggcactcttccccttctataccccgcaatgacccggtcagctcgaggtgctcccaaagcgtcagttcatcgtaaaaactcggccgctccggtatgtaagcataagatgaatcattccactcaataccgccttcaatatcccgggacagcccgagaaccgcctttatcactgtacttttccccgcgccgttcgctccgattaaaccggcaatttcaccagcgttgactgacagagatacatcggaaatcaccttcggcctgtcagcataaccggcgcagacaatgtttgcattcaataattctcccaaacttctcactcccccgctttcatacggacatgtataaaaaaagtttcagtttccataatattaaaagcggtccggacatagtaatgcaccaaggctgcacccatttggaaaaaattatctgcgcttattcctagattcatgtcgtccatatcgtgtataatggaggcagttaaaagagaaaaaaaacagaatgtcatcctttgttgcttattcgtacgaagttttagagtcgaaagttgtggtatatcaagtccatccgatcttatgatagggagtggttttttgaaaccttcaacaaatcgtatgctgactcggattaaatcagtttacatgttcatccaggaaaaaggccttgtgacaacacaggaactggttgatgaattcggcattacacctagaaccattcagcgagacttaaatgtgttagcatacaatgatcttgttcatagtcctagccgaggcaagtgggagacaacacgaaaaaaagtgaaaattacatcttaagcgaacaattacataaggcccttttcggcctgacatgctgcaaggcaaagcagcgtctttgccttgttttttgttcctctatataaaaagcccaaaacaaatctgttttgggcttttctgatatcgattacacttcagcgcctctcagcgtttcgagctcctcttcagtcagctcgcggaattctcccggtttaagatccgggtcaagagaaacagcccccatcgaaagccgcttcaaataagccacttcatttccgacagcctttgccatcagcttcacctgatgatatttgccttctgtaatggtcaagtgaatcaccgtttcatccgggttttctgtaatgatttcaacggctgccggcttcgtcttatagcctccttcaatgacgacgcctctttccagatgaacgatgtcttccgatgccagaggtgaagttaaccggacctcatatgttttaggcacatgctttttcggagaaagcaggcgatgagcgagctgcccgtcattggtgagaagcaaaaagccttccgtatccttatcaagacgtcccgccggaaacggttcaaatcgctgttcttcaggcgtcagcagatcaaccaccgtttgctggcggctgtcttctgtagcggacagcactccttgcggcttattcatcatgacataaataaattcacgatagtctgccggctctccgtataccgtgatgtcctgtttttccggatcgacatgggttttcacatctttcgccggctctccgtcaatcatgacagccccggccttgacgatttttttcacatcttttcttgagccgaatccgctgttggcaagcagcttatcaagtctcatcctgatcctctcctttaaaaagaaaagcccgcgataagcggactattcattatttctcaatgggcggaatgcctgcctctcctcaaaacgcggggcagacggtttccaaacattttctgtaaaaatccgattcggtacgcggcaaacatgtacaccgcaccgccgacagcggcgcagacaaagacgacaatcgccgcatgcacctggccgctttggtatgttacaaagaaactgagcagccattgagtcagcttgaccgcgactcccatcacgacggacaggactgcgattaaaatgacccgttttataagtaccgtatacgaatagcccgcatggcgcttaatcatgataaaaccgtacagaagagaagcgatataaccgagcgccgttgccaagatggccccgtctccctgaaacagcttgatcagcggcacgttcagcaccacttttataatgacgccgatgaaaaggctcacgacagcaaatttctgcttattaatcccttgcaggatcgcggcgtttacggtaaacagagaaaacagaatcgcgacaggcgcgtaccagaacaatatatcctgtccgatatccgggcgaagactttcagagccgtagaagaacgtataggccggacccgataacacggacatcccgacaacggcgggaataaccaaaaacagaataatttgcatcgtctggttaatctgctgattcaaaagcttataattcctgctcgtaaacgattcagtaatcgtcggaatcagcgtcagaccgaaagcggtcgccagagaaaccgggatcatcacaagcttcggcacataaagggtgacaatcgcaagcatgtcctggctgatatccttatggcccgccgcaatcatcgctttattaaacgtattcgtatcgatatatgaatacaaaggaatcgccagtccgacaaatacgtaaggagcggcataactgaaaagctcaatgaacatttttttataacttaagttcgcagacgggacgagattcggcttcatcgccagaagatcgcccttccgcttattccagtaaatataaaggacgacaagccctccgaatgatccgatcagcgccgcgaaagtcgcgtatccgactgcgatgacaaggccgccgttgatcactcttaaaatcaaatacgttgcgcccaataaaaagatgatccgggcaagctgctccacaacctgtgaaacggctgtgggccccatcatctgatgaccttggaaaaaaccgcgcacaaggctcataatcggcacgaccaaaagtgccagactgaccatccggatgacataaacgacgtggtcaatcgtaagtccgttgttactcgtgccgccgagagatgtttccgcaaaaaacggcgccgaaatataaagaattgaaaaagcgatcatcccggttacgagcataaccgacattcccgctctcagcatccgcctgctcgtctcatagtctcctttggagttatatttcgagacaaattttgaaaccgcggcgggaaatcccatcgtggcaatgtttaaaaacagtgtatattgattatatccgtattgaaacaaagctccgcccgtcgctccgaccatcgctccgaacgggatcagataaatcatccctaaaatccgcgatatataggtgccgagcgtcagcacgaacgtgccccttaacaatttgcttgacatgtttcctcatcaccattttctacgaagattcaacttttctattttaacacaactgggcaattagacggtaataattacagcgggaaactttttgggaaagctcttaaaaacaaaatacgtttaaggaatccccttctttcgctataatagcaggaagcggacatttccgcctattatacgtgaaaaagaaagttgttgatgaaatatgaaacattatgacgtaattgtgatcggcggcggcccgtccggtttaatggctgcgattgcggcaggcgaagaaggggcggacgtattattaatcgataaaggaaacaagctgggacggaagctggcgatttccggcggcgggcgctgcaacgtgaccaaccgcctccccgttgaagaaatcattaaacacatccccggcaacggccgctttttatacagcgcgttttccgaatttaataatgaagatatcatcgccttttttgaaaaactcggcattcagctgaaagaagaagaccacgggcgcatgttcccggtgacggacaaagcccaaagcgttgtcgatgcgcttttgaaccgattaaaacaactgaatgtcaccatccgcacaaatgaaaaaatcaaagaggtgcggtacgagaacggcaggacagcgggcattacgacaaacaatgacgaacacattaacgcagacgccgtcattatcgcggtcggcggaaaatcagtcccgcataccggcagcaccggagacggctatgcatgggcggaagcggccggtcataccgtgaccgaactctttccgacggaagtgccggttacgtcgtcagaaccgtttattaaacaaaaaacacttcaggggctgtcccttagaaacgcggccgtcagcgtcctgaataaaaaaggcaaacctattgtcacacacgtgatggacatgctgtttacccatttcggcttgtcaggccccgccattctccgctgcagccagtttgtcgtcaaagaactgaaaaagcagcccgatgtcaaattacgcatcgatctgtttcccggcatcaacgaggaagagttatttcaaaagatgcacaaggaactgaaagacgcaccgaaaaaagcgctcaaaaacgcactgaagccgtggatgcaggaacggtatctgctttttcttctggaacggaacggtcttgatccgcagacaagctttacggaactgccgaaggatcaattcagggcttttgtcaaagactgcaaacaatttacggttgccgctgacggaacgctttctttggacaaagcgtttgtcacaggcggaggtgtttccgtaaaagagattgagccgaaacaaatggcgtctaaaaaaatggaaggcttatatttttgcggagaaatactcgacattcacggttataccgggggctacaatatcacttcagcctttgtcacggggcgtctcgccggtttgaatgcaggacgtttctcacgctcgctgtaaatggtttaaagcgcatttacctgagcgtccccgttgataattgaccaaaaacatgatacagttttctgcgttttgtttcacctgattgagggaacaggaagaaaggaatgatctgcaatcgtgcgaccatactaaaaaatggcgtattgaaaaaaatagtcagagggtgagaacgtttgaagaagaacatctccagtgttttttggattgtgattgtcatcacagcagctgcggttttatgggggccatttctcctgacagcctgcagcaagtcactgatacggcacaaaaatttattacggattctttcggctggtattatctgctggtcgtttctatatttgtcggtttctgtctctttctcattgtgagtccgatcggcacaataaaactcggaaaacccggggaaaaaccggaattcggcttattatcatggtttgccatgcttttcagcgcgggcatgggaatcggtttggtattttacggggctgcggaaccgatcagccattacgccatcagctctccctcaggtgaaacagaaacaccccaagcatttcgtgatgcgctccggtacacgtttttccactggggactgcacgcttgggccatctatgcggtcgtcgctttatgtatcgcttattttcaattcagaaaagacgcgcccggtttgatcagcagcactctgacaccgcttttgggcgataaagtaaacggcccgatcggcaaagcaattgactgtatcgcggtgtttgcgaccgttgtcggtgtggcgacaagcttagggctcggagcgactcagatcaacggcggtctgcattatttattcggcattccgaaaacattttccattcagctgatcctgatcgctgtcgtgaccgtgttatttttgatttctgcgtggagcggaatcggcaaagggattaaatacttaagcaataccaacatggcgctcgcgggtattttaatgatctttatgctcattgcaggcccgacagtgctgattatgaactcatttaccgattctatcggccaatacatccaaaatatcgtgcagatgagctttcgcttgtctccgaatgatccccaaaaacgcgaatggattaacagctggaccattttctattgggcctggtggatatcctggtcgccgtttgtcggcatttttatcgcccgtgtatcaaggggccggacgatccgggaatttttaatcggggtgttggtgacaccttgtatattggctttcttatggtttgcgattttcggtgtatccgcgatggatcttcagcagaaaggcgtattcaatgtcgcgggaatgtcaacggatacgatgctgttcggcgcactcagccactatccgctgacaatggtgacatccgtattaacgcttattctgattgctgtattctttattacatcagcggattcagcgacatttgtgcttggaatgcaaacgtcttacggctctttggacccgtcaaaccgggtgaaaatcatctggggcgtcatccagtccgccgtggcagctgtattattatattccggcggtctggccgcactgcaaaacacggccattctcgccgcggttccgttttcagtcgtgatccttctgatgatcgtgtctctgtacaagtcattagcgagcgaaagaaaaggaatcaaacaagcggagaaataccaaaaaccgagaagtccccgcgtcaaaaaagcataatgcataaaaaagcccggtatttcatccgggcttttttattttcggtataaaatgagagcggaaaaacaataaagctgctcaccttcaggatcacaggccgccgctaccgtatatttaatatcaacgagctgttcatcagaaatcccctttaaaaatgtattgacttcagtctgcagatccttttcatgctcctcatcaaaaacagctatcttcagcacatcaccctctcctttctctatcaatttattccggttcaattgaaatatgatagagaaaaacagattttcttttttactgatttttactaaaagtaaccaaaaatagttattgaaaacgcttactaatatatgataatatcattttaacaataaccaggtcatttctgtttagtaaatatttagtaaaaaggagatacgaaatggtccgtctcaaagatattgccttacaggcatctgtatccagcgcgacagtatcgagaattttgaataaggatgactctttggccgtgactgatgaaacaagagaaaaagttctgaggatcgccgatgagctgggctatcagccgtcggcaaaaaaacggaagaaccgcagccgcagcgattcagcccccctgatcggcgttgtcagctgcctgtcaccggaagaagaacggcaggatccttatttttcagcgatccgaaaaggcattgaggaagaatgctttcggcaaaaagtttttatcacatcttctatccatctcgggtcttttcaagagcatatgtttcacgatctggacggcgtgatcgtaatcggcagcctgcaagacgaggcgcttacgaatatcagcgccgctttcaggcacgcggtatttgttaacggcacccccgatcccgcccgctacgattctgtcagcgtggatttttatgccgcagcgcaaaaggcgatcgaacatcttctgtcgctcggttaccagcggctcggttatatcggcggccgggaacgggagcataccgtcatagacggtgtaaacagcaataaaacgattgaggataagcgtctgaccgctttcttacaaatggccggagccgggccggagcatgtactgatcggcgaatacagcatgcacgaagggttccggctgatgaatgaagccatcaaaggcggaagtctccccgatgccttttttatcgcaagtgattcgatggctgtcggcgctttaaaagccttgcaggaagccggccttcaagtcccgcgcgatacggcaattgtcagcttcaacggaattgatgaggcagaatacgccagcacgccgttatcaacggtaaaagtatacacggaagagatgggccggacgggtgtcaaattgcttctcgaccgtttaaacggcagaaccgtcccgctggccgtgacgctccccacttcattgattgtcagacaaagctgcggctcacaagaaaggaggtgacatgtcccgcagcgtttatatcatatttaaaggaggaaaagatgaaacgcttactggctttgtttctttcttttacttgcatgatactacccggctgctcggcagaacagagcggcgccggagaaaagcagaaaacattgacagtctattccacaatatcctcagacagcgaacgcgccgtattcagaaagttggctgattcattccaaaaagaacatccggacattcaagtaaacgttcatttcccaggcaatgactacgaaaatatgatgagggtcagaatggcagccggtgacatgcccgatcttttcgacacacacggctgggctaaaatccgctacggagaatataccgccgacctcagcggcatgtcttggacgaagcggctcgatccgaatttaaacagcatgctcaaagacgccaaaggcagaatatacgccttccctctgaatcaggcaaaggacggactggcctacaaccgcacaatgttggaaaaatacagaatcaaaccgccggaaacaatggatgattttatgaaggcactgagacagattaaagaaaaaagcggcggaacagtcacccccttctggtttgccggctatgagaaaagctcatttgcccaatattacgatcaattcgccgcaccgcttctcatcacagatcccgcacaccgttacaaaaaacagctgttaaacggaaccttccgctggacacacttcacctatttatctgacaaactgaaagagatgcaaaaggaaagcctgctcaatatagatgccgtgacggcaaaacggtcccagctcattgaactgatggcgcaaaacaaaatcgcctttacgctgcagggcggcaccctcggccaagacgtcgctcaaatcaatccgaaggtaaaagtcggcatcataccgaccccggccgtccacaagggagacgcgccggtttggatcggaggcgaacgttacacgctggcggcattcaaggattccccgcggcttgaagaagcgaaacagttcatcgcatttatggcccgtcccgagcatgcgaaatcaattgccgaagcgacctcgcttccggccggattagtgaatgtgcaaacggacattttctacgcaaatgactataagcgctatcagcatattaaggtgcagccttattttgaccgcctttatttgccgaacggaatgtgggatgtgatggggacagccgggcaggagctgacggccgatatcttaacccccgcggaagtttcggcgaaactcggcagggaatataagcggctccgtcttcaatctgattcacaaggagctgacaaagaatgagtgatcttgcaagagaaacccaaggatttcagcatcaaaagccggtaaaacccgcgtcactgtggtggatgtacgttcccgctcttgccacggtttttattttcatgatttttccgtttgtcaaaggcgcttttatcacattcacaaactggaacggcttctcacagacgtatcaatgggtgggggtcactcaatataaaaggctttttacagatccggacacgtggcttattgtgaaaaacactttgctttacggcatcggaagcactttttttcagaatatgctcggacttttatatgcgctgcttttgaatcagagcttaaaaatgaaggcgctcacaagaacgatcgtctacctgcccgtcattatcagtccgctgattatgggatacatttggtattttattttctcatatgacgggggtgcgctgaatgatgtactgggcgcactgggaatcggtcctgtcaacgccttggcaagccctgcggcaaacccgtggattatcgtcatgattaacacgtatcaatacgcaggcattgcgatgattgtatatttggcggggctgcaaagcattccgaaagattattatgaagctgcaaaaatggatggcgcgggaggtcttcagccgtttttcaccatcaccctgccattattgatgccggctgtcaccatcaacatggtcatcaatatcatcggcgggctgaagctgtttgatgtcattttcgctctgaccgcaggcgggccgggcaattcctctcaatcgatgtcgacgtttatgtatgatttatattttaaacggcaggatgcgggatatgccgccgcccaaggcgtgtttatgtccgttattattcttgtcatcagcttttcggctctcgtgtatttcaagcgaaaggagacggaaatgtcatgaaaacagcccgaatgcggatttttacgctgttggctgccgttatctcgtgcgttcattttgtccccttttatattttgctgaccacgtcattaaaagcaaaaggagactacagttcaaaatggtcgctgccatccgccttttcatttcagaattttcgtgaagcatgggagcgtgcctctctcgggcaatcctttctgaacacgatcattattacagccgtttccgccgccttgctaattttcatgggttcgcttgccgcatacccgctcgctagaagaaatacaaagctgaacaaaatcgtcttcggccttttgatttccatcatgattatcccgcctttgacttccatggttcctttatacaagatggtcgctgatgcggggctggtcaatacgcatgccgcagccattctcattaatacggctgcatatatgccgctgaccgttttcttatattcagggtttatccgctcttccattccgaaagaacttgaggaagccgccaggatggacggcgcgggattgatcaggactttttatacaatcgtgtttcctttgttgaaaccgattaccgcaacggtctgcattatttcctgcgtgtttatctggaacgattaccaatttgcgattttctttttacaagatcaaaaggtgcagacattgaccgtggccatggcggggttcttcggcgaaaacgcgaacaatcttcacttagtcgccgcagccgcaattatggcgatgctgccgatggtcgtattgtttttggcacttcaaaaatattttatctcagggctgtcctccggggcggtcaaaggctgagaagaaaagggaggaatttctgttgaagaaaattacgtttatcggagcggggagcacgattttcgcaaaaaatgtactgggggactgtttactgactgaagcattaaacggatttgaattcgcgctttatgatattgacgctgtacggctgaaagaatctcagctcatgctggaaaacatgagagaccgctacaatccgagtatatccatcatctcctacgatgaccgaaaacaagcgcttacacacgccggctatgtgataaacgccattcaggtcggaggctataaacccgcgacggtcattgactttgacatcccgaagcggtacggtctccgccagacgattgccgataccgtcggaataggcggcattttccgttcccttcgcaccatccccgttttatttgacatcgcaaaagacatggaagaggtctgcccggatgcgtggctgttaaactatacaaatccgatggcctctctgaccggagcgatgctcagacatacaaatgtcaaaacggtcggcctgtgccacagcgtccaggtctgtaccaaagatctgttcgactcactcggcatggatcacgaaggtacggaagaacgcattgccggcatcaaccatatggcttggcttttggagattaaaaaagacggaattgatttatatccggaaattaaaagacgggcacgcgaaaaacaaaagacgaaacataaggacatggtgcggtttgagctgatggataaattcggctgctacgtgacggaatcatctgagcataatgccgaatatcacccgtattttataaaaagccggtatccggagctgatagatgaactccaaattccgcttgatgaatatccgaggagatgcgcggaacaaatcaaaaactgggaaacgatgagagacgggatcatcaacaaccaaaacctgacgcatgaacgctcgaaagaatacggttcgagaattatagaagcgatggagacgggccgtccgttcacattcggcggcaatgtgctgaataccgggctgataccgaatctgccggcgaaagcggtcgttgaagtgccgtgcgccgccgttaaaaaccaaattatgccgtgctattccggcgaacttccggagcagctcgcggcgctcaacagaacaaacatcaacacacagcttttaaccatcgaagcggccgttacattaaaaaaggaagccgtatatcaagcggccatgcttgatccgcatacgagcgccgagctttccatgaatgacatcatctctttgtgcgatgacttatttgaagcgcacaaagaccggcttccggcttatcactgatcattcgcgatccggtcccgggcgggccggacgtttttatatgttcagcaccagtttgaccgtctgtaaggtgtgtcctttaaaatcttcttcaaattcacataccctttgaaaccctttcgcttgataaaaggacaaggcgatgcggttctctttttctgcatggacataaagcttttttaccccgccggactgcctgatgcattctttaagaagtgccgtgcctatcccgcttccctggcaatccggatcaatatagatggcggtcagctccgcatttccgtctttttgaaccggggtggcatttgcaaaaccgagcactcgcccctcttcttccgccacaaagaacaaagaatgcaagagccggcgttccatcatctcatcctgataggcggattcgagaaactgatcctgaatgtgtctgggaataatcccttcatacgtatgatgccagctgcgttctgcgacttgccggacctgtttgatatcgtttgttttcatcgcgcggatcatcggtttcacctgattcgcctcccgttttttttataaaaaaagaagaaaaagacgcacgtcccttttcttctttcacttcaaagcgttatttcttcggctttgtttcgccttcccactccagcatgccgccttcaacattaactgtacggaagccctgctcatgtaaatacatacaaacgttcatgcttctttttccggaacggcagataaatacatattccttgtccttgtctaacgcatccatcttctcagggatgtcccccatgcggatatgaacggcctccggaatcattccttcggcaacttcttcgtcttctctgacatcaatcagatacagctcttctcccgcttttaatttttcttccagtgcggctgtgctgatttcatttattttcaatgtgtgacactcccattcatctttatggtgttaagtataccaaagcccgcggtgcaatttctatgatagaggcctgataaaaaagcccctctctgtaggagaggggcttcgtccggtcagtttgccacgatattgacaagcttgcccggtacggcaataatttttcggatcgtttttccttcaagctgctcttttactttttcgtcagcttgtgcgagctgttctaacgctgctttatcagcatcagccggaaccattaatttcgcttttacttttccgttcagctggacgacgatttccacttcatcgtccaccagttttgattcgtcataagcaggccaagcctcgtatgcaatcgaaccttcgtggccgagtttttcccacagttcttccgccaaatgcggcgcaacaggagaaagcagcttcacaaaaccttcgatatattctctcggcagttcattcgctttgtaagcttcattaatgaacaccatcagctgagaaatgcccgtgttaaaacgaagggcttcgaagttttctgtcactttcatgaccgtttcatgatagacgcgctcaagagtttcgcccgcgccttctgtcactttgcccgtcagctcgccgttttcctcgataaacaaacgccatacgcggtcaaggaagcggcgtgctccgtcaaggcctgattcagaccaggcgatagatgcgtcaagcggccccataaacatttcgtacaggcgaagcgtatctgctccgtgagacgccacaatttcatccggattgacgacgtttccgcgggatttactcattttttcattgttttccccgagaatcatcccttggttatacagcttttggaacggttctttcgtcggcacgacaccgatatcatagaggaatttatgccagaaacgagcgtacagaaggtgaagcacggcatgctccgcccctccgatgtaaatatcaacgggcagccatttatccagtttctcaggtgaagcgagctgatccggatttttcgggtcgataaagcggaggaaataccagcagcttcccgcccattgcggcatcgtgttcgtttctcttctgccttttctacccgtttcaggatcagtgacttccacccactctttaatgttggcaagcggtgattcacctgttccgctcggtttgatctcatcggttttcggcagaatcagcggcagctcttccgccggaacggctgttgacgtaccgtcttcccaatgaatgaccggaatcggctcgccccaatagcgctggcggctgaacagccagtcacgcagacggtatgtcactttcttctcaccgtttttcgtttcttcaagccaggcgatcattttttcaatcgcttccgctttattcagtccgttcagaaagccggaattgacatgttctccgtctcccgtgtacgcttcttcttccgtgtttccgccttttacgacttctttgacaggcaggctgaacactttggcgaattcaaaatcacgttcgtcatgcgccggcacggccattacagcgcccgttccgtaagaggcgaggacataatccgctatccagatcggcagcttttccccgtttgcagggtttacggcatatgcacctgtgaagacgcccgtttttgttttcgcaagatccgtccgttccaggtcacttttcgcctgaacttctttaacataagcgtctaccgcttctttttgttcaggcgtcgtgatggcctccacaagctcatgctcaggagccagtacggcataagccgcgccgaacagcgtgtccggtcttgtcgtaaacaccgtaaacgtgtcatcagtgccgtcgatcgcgaaatgcacgtttgcgccttctgagcgtccgatccagttgcgttgcatgtctttaatgctttccggccagtcaagttcttctaaatcttcaagaagcctgtccgcataagcggtgattttcagcatccattgtctcatcgggcggcgttcaaccggatggccgccccgctcgcttttgccgtcaatgacttcttcgttcgcaagcaccgttccgagcgccgggcaccagttgaccggcacttcgtctacgtatgcgagccctttttcgtacagcttggtgaagatccactgcgtccacttgtaatagtccggatcagtcgtattgatttcacgatcccaatcataagaaaatccgagtgattggatctggcggcggaaattatctatattttgttttgtgaactcagccggatcatttcccgtgtcaagcgcgtattgctcggcaggaagcccgaacgcgtcccatcccatcggatgaagcacattgtacccttgcatgcgtctcatgcgagaaaggatatcggttgccgtatagccttccggatgtccgacatgaaggccggctcctgaaggatacggaaacatgtcaagcgcgtaaaacttcggcttgtcattctcttcactgacggcgaacgttttatgatccaaccagtaattctgccatttcttttctattttttcgtgctgaaaactcaacgtaaaaacctccttctgattgaatacggcgtatgtagtccaagtattgacgggatgaggaagattatattcagattattctaaaactaaaaaaaactccctcatccctaaaagggacgagagatttttgtttcccgcggtaccaccctcgttagcgcggttttaagccgcactcacttgatacttttaacgcagttatgcgtcagcggttttgccgctgcaactctgaggcgagttcggaaacagacttgattgacttgcaccggccgtcaattctctgagtgcgaaatctgcttcttactgctcctcttcactgttcttatcgctaccgtaatcttacctgtattttatagaattctgttcataagtgcaagcaggtttgtatacaatgggaatgtacccggaacgggtcgtgagcggggatattattttgatggaggatttttttgctggtgtggttttgcttcggccgaatcactgttttgttctctgacaaaatcaaagctcctgagaacagcttctccgccgtagcctgcgattatggataagatgacgagttgaattcctgaatcggggtcagcggataagacaagtaagatggaagcagccattccgataaaaccatcttccaaaaaaccgagatagataaaccgctttgtcattctgggtttctccagcctgcctctctttttcacatgaccgagaacccccatgatgcctccaattacacaagcaattattacctgatgcagcatcttcatcaccttcctaaagcccttatttagtaaagcgacttcaggccatccagcccccttacgaatacgatgattttcgatatctacataccggcgattgagcaggaaagtaaaaagcttgtttcttccattatatgtgaacacatgatcggtaagcttgatgcattagattcatttttcacccagtgacaatgacctagtcacttacttagcgatgatgtgccttccccttatatattcagtgtatatgaggacaagcccgaatgacaaattgcaaacttcggctgcttgaatcagaacatatgttatgctacggttactgtagattcatttaaaaaggggagaaacaacggctgaaaaaagcgcgcagctttacggccaaaagggggttttacatggctgactcaaatgtatccggaaaactggagcagctggagcttatcaaaaaggcgcttgatcacgcacgcatcggcgtggtgattacagacccctctcttgaggacaatcccatcatatatacaaatcagggatttatggatatgacaggctacgcttccgaagagatattaggtaagaactgcagatttctgcaaagcaaagaaaccgaccgtcaacaagtcgcgaaaataagaaagagcttaaaccagaaagaaaagatcacggtgcggctgaaaaatgtcaaaaaagacggcaccccgttttggaatgaactcaacattgatcctctgtatgttgaagacaagctctattttgtcggttttcaaaaagacattacagagcagaaagaatacgaaaagctcctggaggattccctcacagaaatcacgacgctgtcaacaccgattgttccgatccgaaacggcatctccgccttgccgttagtgggaaacttaacggaagaacgatttgattcaattgtgacaactttgacggacatattaaccgcatctaaagatgattacttaattatagacttatcaggtttggccgaggtaaacgaacagacggcagaccagattttcaaattgcaccacctgcttaaattaatcggcacagaactgattatcaccgggatcaagccttccctcgccatgagaatgaatcagcttgatgccagcttttcttcattaaagacgtatttaaacgttaaggacgccgtcaacgtgcttccggtcgtataaacaaaaaaatcccgctgtttcggcgggattttttatgtcgtcatcgcacttggatgttttgtttattaacggttttcaggcgtttgtcgtacagcaccgtcgctgcgatgctgacaacaagaagcaccatcaggatcaacagcagcacgctcatgccgtactgatcaaccagcacgccgccaaggagcggcccgatcattctgccgcccgtcgccgcactgttgacgaatccttggtaaaacccttctttccccttaggcgcaagctgattggcaatggtaggaacggcaggccagacaagcatttctccgacggttaaaatcaccattgcggtgaggtacatcggaaattgcttggcgctaagaagcacgccgaacgaaacgataaaaatacaaaagccgatgaccatctgcgtttttaacgcgcctgaccattttttcagaacagctcctatgagaggctgtccggcgacaattaatattccgtttacggtccagagcacactgtataatgaaagcggcataccgatgctttgagtatgtgacgcaacggttgtggaccactgcgaataggcaatccacccgagaacatacccgccgctcaatatgagaagcgccgtaaatttcgttctgctgctgacaggctcgtagtccagaacagaaacctggctcgcatttccggttttgatatttcgaaacccgaaaaatacgataaggaaaaacagcacatacagcaaagcattggctaaaaacacgtacgtaaacgagtacgccgcaaccatcccgccgagtgccgagcccacggcgacacctgcgttctgagctacataaatcgcattaaaagctctccgcccgccttctttccataccgctcccgccatggcgtaactggccggaaacacgataccggaaccgaagccgacaatgatgagcagccaaatataaacgggccattggtgaaacagaacgagtccgagaagacttgccaatgtgatcataatgcccagcataatggatttgaatccgccgattttatcaaacaaaaatccgccgcataaattccccgccacactggccccggaattcagcatcagaacaatccccgcaacagtcagcgatttccctaaatgattatgaatatagatcgtattcagcggccacaaaaaagatgcgcccgtcacattgataaacattccgatgattaatatcttcaaagcgcgcggcataccgatccccctctctctataaaaaaccccatgaaaaaacggaaaccgcaagccgcggctccgtatcgatcacgttatcatagcacattcattctatcgccgcggacgtcttttttcaacatcagaatctgaaaaaaataatgccggaatgttgaaaaaattacaaatgattggattcgcaaaaacagcccggcttcatgctcttttcctcagcagccaaaacggaatatacagaatgaagaagctcaatatcaccgccgcttccattgatagaagataccacggccaaggtccgaaaacattcagaagcgaagcggtcttcggttttttcattaaatatagataatttgcattcagcacacgatcaataaaaaagacacacgccccgtacagatttacgatcagcaccgacacccacagcccgcgcgccgacggcctgtacctttctgaagcggccatgaatagacaggtaagaaaaacacagccgtgggagacgaaaaacacgatgtaccgaaaatgcgggaaagaatacgcccctaaatcaggtgttgccatcgcctgtacggcgctgcccaaaccggcaaaatagaggaaggcgaatagctttttgctttttgtcatgaccatcagcatcgccaaatagacggaaaggtcgctcagctgcagcggcagagctgttttcagcgaccaggcatgatgacaaagcagccatatatgatagctgatctgcgacacggcaaggagaatgaatagtacatagcggatcatgcggctctggttgagctttttccggaatacgatcacgcccgcccccagcaacccgatgatcaacaatgtgaaaatgtgttccttggaaaaaagatgaaaggcccctgtttcagatttcaattgaaaatacttctgcataaggctcccccgcgcgaaaaaatgacgtatgtctattcttttaaaaatcgctttcttctattcatacaaaaaaagcctccgcttatgcggaggctcctcaacttgttttacaaggcggattgaatgacctttttataatacagcaccgacagcatgccgaagatggagtacagcagcgtatacagcgccatgacgatgatcatcggcgtccacacttccgttccgaataaaaaccatcctgactgaacggcaaaatagctgtggaacagcccgagaacgagcggaatgccgaaatgatacgcctgcttccggcggatgcctttcagcagatctcccgttgtgaagccgagcttccgcaatatcgtataatcagccttctcatcctcacactcgcccatttgtttaaaataaaggatacagcctgaggtgatcagaaaggttaatcctaaaaacccgacaataaacatgatcagccccatgtttttcttttgcgtgtcagccgtttcaaattgtgaaagcgcaccgtctgaatagtgctgcgcctgaaacagaccatcagctttttggatgtcctcttctcgtttgagtgtaatgccgaaaaaccgatttgattttccctggatggacgggtcgatatctttctcgatccggtcgaatacctgctgcgtgacgataacggtcggcagccctccgcttgtaaatgtatatgacaggaggaagtcgttcttcaagcccttatacgccagcggtattttatccgttttgccgtttatatcaatggaacccgacgttttcaggtcgagaaatcttttcatcatatcattatatccggtaaacacggcttctccgtcagaaagctccgtcccttctgcgtctttctcgcttataatcggcagcgccaggctggacgggtcttgttgaaagcttttcatgtcgccgtttataatgttcttcatattgacaccggcttgaatggtcttgattgtttttactttgtgttcaattccgtttttcttcaataaagcggtaaaagagtcagtctccttttggttatcaaacgcaaagtccgcggctgtattttgctcagccgatttttccgcggagtagtacgagatatagcttaaagacagcaaaccgattgccagcgccgaaagagtcgtaataatcgtcagcaatacggcgtttgacttcatccggaacatgatggatgacaaagacagcacttcactgacattcagatacccgccttttgatttccggatgagatttgccagaaagctgaccgaacctttataaaacagataggttccgataatgaccgagccgagaataaacaccatggccgaaaacagttcattcatgctcgtaaaactgcctccgaataaatccgcggacacggcatagccggcgataatggccgcaataccgacaacgccgatcaacatctgcacccaagaaagccgtcttatgccgctttctgacgatgacgcggttttaaataaagacaaaatgctttgccgtttaataaataagtaattcatcatcataatcagcacgtaaattgccccgaacacaattaacgtctgaacgagcgccttgcttgaaaaaaacagtgagacagaggctttcacaccgactgtatgaaacagcatcatcatacataatttcgagagggaaaagccggcgaaaataccgatccaaatcgatccgaaatacaaaatgaaattttctgcgctgagtatgcggaaaatgtgcattttcgtcatcccgattaatcggaataagccgatttcccggccgcgccgtttaataaaaatggtgttggcatataaaagaaataccgacacgatcgccacaagcagtacagaggcggcccggattgccgccgctccttttatggagcttttcatttcatcaagcgccggatcgtattgcatcgtgacaaacgcgaaataaagggcggcgctgaacaccagcgcaaaaacgtaaagataatagtttttcatattctttttcaggttctggaagatcaaatgatgaatactcatgcctgaaccccgcccaatacactttgcgttttcataatatcctgaaaaaagtccggtctgtcctgaccgcctttattcagctgcgtatacacacggccgtctttaatgaaaaccacacgtccggaatagctggcggcaaccggatcatgcgtcaccatcacaatggtggcgcggcgtttttgattcaggcggctgagtttattcaataaatccgtggcagcctttgaatcgagcgctccggtcggctcatcagcaaaaataatgcccggctcgtgaataacagctcttgcggcagacgtccgctgtttttgtccgccggaaatttcactcggatacttatgtctcaaatcatagatcccaagctcctctgccgtctcggcaaatcgcaggtccgcctctttcttagacattttcgtaatggataacggcaggagtatgttttccttcacggtcagcgtgtccaataaattataatcctgaaaaataaagccgagatgccgttttctgaattcggcaagctgtttttctttcatggatgtaatctccgtctcgttcagtttaatggtgcccgagctcactttatcaatggaggaaagcacattcaaaagggtcgttttccctgatcctgacgggcccataatgctgacgaattcccctttgtgaatctgaagatcaattcctttcagcacctcttgtttattcagcttgtttccgtagcttttttggatattgcctgcttctaaaatcatcacgttatgattctccttttacattggttatctttattttaaaaacagaagccgtttttttcgtttgattaagcgaacaaaagagaaaagcatgtgacacttttgtcacacgctgaacatgctgacggcatcgttctgttttggaaacaccaaggtaaaaatcgtgccgctttccggctcagagcgcacgctgatctggatgagaagcggagccgcggcttttcgagccaaatacaggcccatccccgttgacgcgtgatctcgcctcattcgcgtcgaggtaaatcctttttcaaaaatgcgcggaagatctttgggctcgatgccgatgccgcggtcttcgatatcgacatgcacccggccgttttgttcatagctttttacggtaatgtcatccgcttcactgtatttgacggcattgcttaacagctgcctgatgatgaaggaaagccattttccgtcactgtgaacgtccggtgaatcaagctgaatgtcaaacccgatccctttttgtatgcaccatgattgcaggtttttaatttctttgaaaacgagcggtctgagctgaatgcgctggaatgataaatcattttcaataaaggacaatcgtttctgatgaagctgctggtccaggagatggtgaatccgcagccattcatacagcaaaggggctttcagcggctgttcatcaaggcgctcgatcatgagatgcatcgctgtcagcggtgttttgacctcgtgaatccatgacatcagatcatccttttcatgctctgacgccgcctgaagatcaagtgagctttttcgtaattgctctgtctgcccttcaatgctttcttcaacgatagactcaaacggactgtcaggcgctttaagataagacatgtctaaattggcgtcccactctcttaagcttttataataggcggtctctttacgatagcggaacaagagaaatacaagaaacacaagaagcgacaggtaaacaaaatacagcaccgaaaaaaacggaatagacgcatcaatatatgccgcaaaaaggagcacagcctgctgcaaaagaaacatcgcgatccagctttttctttcgagcagaaatgatttaatcataaagaccgtcttcttcctttgcgatgtatccctgccccaccttggtttcaatcattttcccgatgcctaattgatcgagttttttccgcagccggttgacattcaccgtcagcgtattatcactgacgaaacgctcatcattccataggcttctgatgagttcttcccggctgacgattttatttttctgctcagccagcagttttaagatcagcatttcgtttttggtcagttcgaccgaaccgtttttacagctgaccgtgttggtttctgtgtcaatgaccgccccgcaccatcttttcatcagcgccggttctgtgccgtattggtgcacacggcggaacaccgcctgtattttcgcgattaacacatcaaagtgaaaaggcttctgaataaaatcatctgccccgagctgcatcgacatgaccatatccgcgggatgatcgcgcgaggacaaaaagagaatcggcacgtttgattgggagcgtatcattctgcaccaatgaaagccgtcaaatttcggcagctgtacatcaatgatcaccaaatcaggcttaatttcagtaaactcccggatgacccggctgaaatcctttattccgtgcaccgcaaatgaccagcccgttaatctctccttcatctcgtgaaacaaagtgttatcatcttctattaacaaaatgtgaaacatggtatccgcccttttctgatagatagaggaaaaaccggctgatgtccagccggcttttttcctttacagttctcttcttaatgcggtcagaacgttggtttttgtcgctttgcgggccggattcataccggaaatcaccgcgacccccgcacaaatgacaactgcgatcacaacgaggctgagcgggatgtaggagaaggtataatgaagatcttcagctccggtatttccccctaccgctttcaaaataaccggcacagccagattgacggcaaaactcactccgtaagaaatgataatcccgatgacagaacctaatatcccgatataggcgctttccatcaggaacattctgcggatgatggacgggcttgcgccgatcgctttcataatcccgatttcctgcgttcgttccgtcaccgccatcgtcatcgtattgaaaataccgatggctgaaatcacgacggcgataaagccgacaaagatcagaccgattttaaagacgaggaaaaaggtgttgacgcccttcagctcggttgtgacagatctgacataaaagccgtcatccgtgaggtcatgggtaagctgatcgacatgatcgaatttgtccgcatacacattgatgcttttttccgcatttccattcttcagatccaagaatgtcgagaagtctttcttgaattgatcactcacaaaaatatttgtatcctccatccaatcttgggacggtttttttgtaattccgactactttgaagtcgtacgttttcgttttttcaacgtctccgtctttgtttgttttggagatgctcagctgtatcgttttattaagcaggtctttcgtatagccttttggttttttcacctccgacatgtcgccttggtgatcctttaactctttgtcgtaagcgtcagcctcttttttcgtcaataggttcttcgcaaaatcatagccgaccacgatttcattctctgtacgggcgactcttccctgatcaagctccatattggctttgacttcatctttcatgtttgtcagcacaatggctgaatcttcatttgttcggtttcccaatgacgctttgttcggttcatacacttgtgttctctcaacgacagacttgacatttttatacttttccaagtctgatttcttcacggcttttccgttctcttggccgagcacattgatttccgtaacaatctgctggctcatcgtaatgtctgtaatcgttttttggatgccgaatccgacggaagccagcaccactaaaaacgcgcacgccattgtcgtcgccagcaccgtcatgaaaacacgcagccggtttttcttcatatttcttctgataaagtgaatctgatccttaaatctcaacagtaacgcccccttttaatacaccgtcatgcagctggaattttgaatgcgcgatcgaagcgacttcatcgtcatgcgtaatgatgacaaatgtaatcccgcgctcccggttcagctgctgaattaatgcaagcacctcaagttccgtttctgaatcgaggcttcccgtcggctcatcggctaaaataattgacggatttaaaatgagggctcttgcgatactgacacgctgctgctggccgcctgacagctcattcggataatgattcgcatgattttcaagtccgacccgtttcagcatatccgcgactttctgcttgcgttcagacggtttgacaccttttaaggcaagcggcatttcaacattttcataggttgtcagactcgggatgagctgaaagctttgaaaaataaagccgaaatgcccgaggcggaactgcgcccactctttttcattgaaacccgtcacatcagtgccgttaatgacgatacggccctttgtcggcgctatgtatcccgaaattaaattcagaagcgttgattttccggaaccgctccgcccgacgatacaggcaatttcccctttttcaacggtcaaagagacatccttcagtaccggaacctcactctctctgcctttcctgccgattttaaatgaatgatcgatatgctgtacctctatcacgtacaccactcccccttatatctgtttcgtttttttatagatgaagtaataactgatgaaaaacccgataatcgcaccgatgagcatgccgaatatgtaaccggtatacgaaccgttataagcatatccgcatacccccgcacttcccagcatactgagcgacatgacgagcacttgaatgatgcgttcaatgtgtttgctcaggataaaatgtccgcttcgttcattcggcattttcaggaaattcacatagccgaatagatagaaacaaaatcccattaatgcggagatgaacaatgcgtgtttcatgtaatacatccatgatgtatggatgtaagcggcaggcatgaaatagatcagaaatccgctccaagggaaatcaatatccggcacagcctgcctgccaaaaaggaactcggcgtttaacagataaatcgtcataaccacgatcggaaagacggaaaccgtgaacgctgtgatcagctgcgccgctaaattgcccgttatcgtgccggcagctgtcactaatgcgtaaatcatcaagctgatgaccagcatccctgcgctgaatgattgaaaatgatggacagcgtcaggtttaagcgctaggaacaatatgtcggatactccgtaagaaacaaactgcgagccggctaacacggctgctcccaagaaaaacttcgtatgaaatatccggcttctcgaatacggaagactcagtgtaaacatcctttcagcccggcctgctcttatcagaaaaagccccataacaaccggcggaatgaaatgaagcccaatcaaattccgataattgctgtaatcgatgctgaatgtacaaactgaccccgggtacagctgaagtgcacgtaaacaatccttatagtgaaaatactcatttataattgccaaagggcctaagatagataagaaccccgctgtaagcagcagcagcgtctgccgctgcttacattctttataaagcaaaccgctaatcggcaccttgccttcctccaaactgctcattttcaaacggatctacatatgctttgactgtctgtaaaccgtaaaataactgatgaaaaacccgataaccgcgccgaagataatgccggctaaatagccgaacatcgtgtctgtgaccccatatccgaaaacgccgaaacccataacggcaaacgcaatcaccaagatctgcaccggccggtccaattttctccaaagaaagaatctgccgttccgttcattcggatgtttcagaaagctgacgtaaccgatcagataaaagacaaggctcatcacaatcggaatgattaaaatcaaatctctttctctgatccagtcgttaaacacatatccaataggggttataaatataaaaagacgggattcgatataactgctgataaaagaaaattgatctccgacactaaaatcgaaaacgacctccaaattcgcggccggcagaccgatgagtaaaaagggcagaaccgttactgtaaacgccgttaacagctgggcgaatatatgtcccgttattgctccggatgccattaacaaggcgtaagccataaagctgatgacaatcattccgattgaaaaatgatcaaaatcgtacgtatggctcggtttcaacaaagatatcagcaatgacgccgctccatagcctatcgcctgaggagcaacaatgactgccccgccgagccagaatttcgtctgaaagatttggcctctgctgtaaggcatgcttaacaaagcatccatcgttccctttgtccgttccaagcctaataagaagacagcaatgatgacactcacaacccagctgaaggaaagaggcgacccattcgtataattgacaacgaattcacaatcttgaagagctgggttattcaaacattcttgatatgttgagtagttgttataaaccataaaagggtttgccgccattaaaagaatgccgctgcataaaaacaaccactgattttttttccattctgtgtacaacaatccccgcggtatcattccggtcctcctctcttacacatgcttcgtttttttataaatcacaaaataactgaccaaaaatccgatcgctcctccgaccagcatcccggccacataccctgtcatcgtatgtcccgtcgagtaccccgccaggccaaaaccgagaacggcgatgatgatcaccacaatctgaatgggccggtcaagctgtctccaaagaaaaaaacggccgttccgttccaccggctgcctgacatagcaaaagtacccgatggcataaaatacaatgctcatcactgccggaatgattaatatatacttgctggcagatacccagtccgtattaacatacatgatcggaatcagatattgaaacgaatcgtttaggtaagcattgactgatggcatcagctcatgcatgccgaccctgaagataacttccgcatttgtcagcggcaacgtaataatcaggtaaggcgctatcgacacggcaaacgccgttaacagctgggcgaacgtattccccgttaagcagcctgcgctcgcgaccaatgtaaaagccaaaacactcacaataatctctccgacgctgtaatggtggaagaaatatacgcgctcaggctttaacagaagaatgagcagctcagccagcccgtagccgatcacctgagcgccggtaatgaccgccgctccgagccaaaatttagtgtgaaacacctgagcgcgggaataaggcagactgaaaagcgcatcaatcgttcctttcgtacgttccagtccgaataagcaaaccgccaaaatcacagcgggcgcccagtttaagttcagcattccgctatccaaagaattcacataaaacttacaatatgcttcgtgggtgtccagacagccttgataaaccagataggtatttaacacttcaaatggattgaccgccgctaaaaaaatgccgaccatcacaagaacagttcgattctgcacccattccctgtacagcaatcccctgtctaccatctccggtcccctccaaacttcgcgatgaaaacttcttctaagttcacaggaagttcgttccatactttcggctgcagctcttgcagaaagttctttttcttctcatcgttcttttgaatcagcaccgtataaaacacaccggcatggtcgagaatcggtatattttgttctctgatcttcaaggcgacgtcctcttcaaatgccatttggattttcatgtactcttccttcatatcatccaagtccatcacattcgtcagctgatttccttccaaaaacccgatccggttgcacattcgctcaatatcttctaaacggtgtgaggtaatcagaatgctcgtttcccgttcagctacttcatccaccataagctgcagcacgtcatgacgcgttacggcgtcaattccgtccgtcggttcatccaaaaggataagagccgggcgtgaagcaaaggcaaggacgagcgcaagctgttttttcaggcctgtggataattcacggtatttcttcgtttccggaatgccgtacctgttcatcagctcattggcgtaagtcacatcaaaattcggatagattctgcttacaatcgcaacaagctgtttatatgtatacttgtcataaaaaggattttcaacaggcatataaataatgttctgtttgactttcggatgacgctttatttccacctgattaaataaaaccgtcccttgatccggaagcagaatctgctgaatgagccggagcagtgttgttttccctgatccgttccgcccgagcagcccgaaaatttccccttttccgatggtgagcgaaatatccttgagcacttctttaccgtctatcgtttttgagagattccgcaattcaatcatgatcctttcctcctttcacatcagcgctgatttcctttatccattcctgcagcttctccagctcaactcccgcgtaatgggcatcgatgatgagctgtttcaattgctcttttatcatcgtcatcttcccttcaaccaatgtcgtttttgcattctccgatatatacgttcctcttcccctcagcgtttcaatgacaccatcgcgttcgagctccttgtacgctttgctgactgtgttcggattggcgataatgatcgttgccaattccctgacagaaggaagtttatcccccggcttcatgatcccttttaaacaaagctctttcaattgctgtatgatctgctcataaatcggagttgagcttctcggatcgatttgaatcatttacttcccttctttcttttacgagctgctctctttctttaaatgttctgccattgaaaaccgatgacgacaagaacgacaaacagactgctggccaaaaccgaagcggcgataataagaggcacatcttgttttacggatcttttgtttttcatgaaagttccccttccctatgcttaacatttatatgtcgattcatttttcgagtgttttatgtgtattacatcaagtagtacacgtaatacaataaacacactcaggcctattgtcaattctttttttaaaaaaatacaaaaaaacccgccgggattccggcaggtttgctgaaccatttgaaacggcgcggtcagtaatcaaaattacgctgcaaaatcatgttgttttgcaaggtctgcagctgcaatctcattcggtaaagctgctctctttgctgatcattcgcagataatgacagcttgtttaattcattcaccgcgttttcaagcatcatttgcgcttcactgtactcattatcattataatgctcttgttttgaagcggtcataaattgctcattcgcaaattcatatgcctgttcgcttctttggagatgttcatctactgattgtcttgttgccattaaacagtcctcctattgataatgtcatatcaatagtatttcttattccaaattaattctcacaagaaatatcaggtaattcattcacaagacagagatggcataaaatacgattaaatgtaaaacttaatcaagacagaatgaagtctttataaaaatccttcattttagaacgataacttaattcttcttttattaaaaacatcataatttttccacatcacccacaagatcttcggttcgctttaaattgttcaccattaaattatcttttttgtgtaaaacacccgggattcatcaaattttttagatctgtttttattagctttaattatcatcccgaaactaacaccaactataaaacttactcatccccatctaagactggaacagctttaaattttttcaacaaaccgttcaaaagtgaatcgaattttgaagaattaagataatagtatgttttattttgatttctcgtactctcaactaaaccttgcaatgtcaaaattctcatatgatgtgaaatcgttgcgttggttaaatttagctgttcagcaatctcattagcatacatttttttatgactaagtaagattaatatcttgaacttacttttatccgataaaagcttcaaaaaatcaatgatatgattaatctctgctttctctaatgtattttcaaatattttatcaactttataacccagtccaacataaatgttatcttcacttttcgtaatagttgcagtgcaaggtaaaagtgttggatatatattaatataattacaagataagtattccttaccttttaacgtactgattatcttttttggaaaatctatatttatgttttttaattgattcatccactcatctctgaatttaattaaattataaatcgcctcgttaagataaccattcaccaacattaatttattgcaaaattgatctacataagttttaggagatttcattaccttaaatatgatccacttgtattcgggctttatatttagattattaagtagctcaaataaactttccctatcatttaaatactgttgggtagatgtttcggttttaagatctccttgtaaataaattagagactctaaaatattttttcttatctcttcttctgtaactgcagacaaataatcaataatttcaaaaaaatctttcgtgtaaatttgtggtattttaaaaaatgttgtggctaaacaaaaaatatttgcattcctaacatctttgtagtcgcaaaagctgccaaaataaaaatttaaaaactcactatctaactcttttattcttttaagatcatctaataatacaaaatattcattatctaaattcaaacccaatttggttgtataatctttgaagaattcctcgtgttttaagaatagaatagaggatatcttgtcaaagaattctgaaacactgtcatttattattaaccgcactttttcacaccccataaagtctttttccacaaaggaaaacgttgtactatcttcatgccagacattttacatttttaatattatcaatcaaaaggaaactttcaaagaatattcatttctaattagcacttacctgactgagcattatcatgagcagtcctagatttattagacttgcttcacctcatgctaagtattctcctcatgtcatactcttcagaaatccttaatcatctcagctagtttacaggtccatttaagctcttattgagttatttcaagttacaaaattgttgaattataaaaatatgatttcgagataagtggatgaaaaaacaatttatgaataatattgacacctcttaagattgcatttatcatgtttttagatatatatcgaattttaatttagattaatatctgatggaggttgtagttttgaatttcaaaaaattaattatgttatctgcattattattaggtacattcatttcggtaatggacaccactatagtaaatattgcattacctaagatgctggattacttttcgagcaacctttctcaagtagcttgggtggctacaggttatactttagcttttgcagttttattagtaggtgcatcaaagctggcagaccattttggaagaaaaaaagcttttatgtttggattagcactttttattttgacatcagttattgcctgtttgagcacttcaattgaaatgcttatcacaattagagtgattcagggattatctgctgctttcattgtgccagttacaatgcctattgctttggccatcgttcctcaaaataaaaaaggattgatcattggaatctgggggctttctcaggattagcagctactttaggacctgtacttggaggattattaactgaaaattttaattggcaagctatcttcttcataaatattcctttaggcctgatttctctttttttagcagcattttttattactgagagttatgatgaaacagtgagtaaaaaaattgattacatggggattcttattttatccggagctctcttctgtttaacctttggctttgcaaaagtatctgatttaggctggtcatcaccattaattatctctctttttgtaatctctgtattattattctgtttgtttttctttattgaatctaaaattaaaaacccgatgattcccttatccatgctgaagatacgtacgtttagtttcagttctttcaccctctttatgcagggccttggattaacaagcggtacccttattattactttactcctcacgaatttaatgggaaaaactgaattagaagcggggttaattgtttctacattagctctatcatctatgtttacctctgtactttctggaaagctatctgataaactcgggggcatttggctttcgggtctaggtatgctcggtttaacaatcacaacatatttatatggatacatacgatacgacagttctgtaacaacggtagttattctgttatgtttgaccggcttagctttagggcttgtgataggaccggcaatgagttcagggatacggcttattcctcctgagaaagtaggtattgcctcaggtattcttaatatgatgcggacagttggacaagcgctaggcattgccatacttacatctgtgcttacaatgaatataaatgatcacacagcttctgcaaaaaaagaagccataacaattgtggaaaacaatcaggtttttgataaaaatgcaaaaaacgagataataactcacttaaagcattcagacagtaaaggtttcgatcgaagaaaaagtattgctgaattaaacaaaaaagaggaagaaattctttctataaccccggatccatataaagaaaaggtacaaaaaagtttcaatactcaaaagaaggaagttatcgctatccagaaaaaaatttcaaatttatataatgaaaaaataagtgacagttttaataatacattcaaagtaggcagtgtaattcttattttaggaattatttttgcattgttcagtgatatttctccaaaacgattaaaacaacaacagaaaaaccaggtagatattacgccttgaccgttccataattgtttcattgttccgccccatcattcatgctacaattttaggatgcatctgatgtgagggaggctttttgaacattgaacgagaataacccttttccttattcaaatacggaaaaacggtaccatacattaaattatcatctgcgggagcatttcgggcataaagtgtttaaagtcgcgcttgacggcggttttgactgcccgaatcgggacggcacggttgcacacggcggctgcacattctgcagcgcggcgggctccggcgattttgccggcaaccgggccgatgacttactcacgcaatttcacgatatcaaaaaccgtatgcacgaaaagtggaaagacggtaaatatatcgcatatttccaggcgttcacgaatacgcatgccccggtagaggagctgcgtgaaaaatttgaatccgtcctcaagcttgacggcgttgtcggcatgtctatcgcgacccgtccggactgcctgccggacgatgtcgtggaatatttggcagaactgaatgagcggacctatttgtgggttgaactcgggctgcagaccgtgcatgaacggaccgcactcctgatcaaccgcgcccatgattttgactgctatgttgagggtgtcaataaactgagaaaacacggcatccgcgtttgttcccatatcattaacgggcttccgcttgaaaacagggacatgatgatggagacggccaaagccgtcgctgatttggatgtgcaaggcattaaaattcacctgcttcacttattaaaaggcacaccgatggtgaagcaatatgaaaaaggaaagctggagttcctttctcaagaagaatatgtaagtcttgtatgtgatcagctcgaaatcattcccccggaaatgatcgttcaccgcattacgggagacgggccaatcgaattaatggtcgggccgatgtggagcgtcaataagtgggaagtactgggcgccattcaaaaagagctggaaacacggggaagctatcaaggaaagctcttcagaaagaccggggaggagaccgccctatgaccttgatgcacatcctccctttcagtaaagaattgctgaagtccgccgcacaggaaggtgatatcacggttgacgcgacgatgggcaacggacatgatacatattttctggccggccttgtcggtgagacaggacatgtccatgcctttgatattcaagcggacgcactcgctaaaacgaaggagcggctcggtgccgacttcggcccgcgcgtcacgcttcaccataaaagccatgatcaaataaaggcatcgctgcctgaagatgcgcacggtcgtgtggcttgcgccgtctttaatctcggctatctgccaggcggcgataaaagcattacgacaaacggtcactcaaccatttccgcgatcgaacagctccttgaactgctgaaggagaacgggctgatcgttctcgttgtgtaccacgggcatcctgaaggcaagacggaaaaaagtgcattactggaatactgcagcaatcttgatcaggaaaaagcccgcgtgctgagctacggctttctcaaccagcaaaacgacccgccgtttattatagcgattgaaaagaaatctgccggcaaataaagaatcggcctgtcataagcgggccgattctttttgtatttacttttcaagaaaaatcaattactatgaaataatggaaaaaagttcatcttttaagtgtaacatctgggaggagcggcaatttgaatattcttcgcatcatattttcaagtgttccctatgtgatgtttgtcatcattttatcaagacatttaggatttgagttcgcgaaaacctattactggtggtttgctgcattttttgtcatcgggctgatcggcaaattcgcaatgcaccttgcggcaaaaaagaaaccgttaaaaaaagagacagcgtaaaatgcgcatgtctctttttatttactgttttgcagcacgctgcgtgtataagcgggattgttcgtaaagacaccatctgctttttgtttcagcataataggcgtcagcgtatgctcgtcttccttatcaaaaaacacgtgcactttcatcttattgtgatgaatgcgcttcacgactgcttcatttgccaatttggcgttgatcccgactgtatcagcatacgttctgatggtttgcagctgcttatcatttatctcctcagcctcgttatcttttaataatcgaacaagaggaacttttttattcatagaacgaactttctttaagctcttcccgctaaaagactcaatgactgctttatggccggaaatcagcttatgtttttgtaatatgtcaatcagtttcttttccatcaccaggctgccgttgctttctcttgtctcaatatagtaattggcagtttgtccgaatttctgtatgatttcttctaatgttaaaatcttttctccttttcccgcattcagtttcttaatctgagccaaagacagatcatctgtcatccctttaccatctgttgtccggtctaccgttttatcgtgaattgcaatcagacggccgtccttcgtctcccgtaagtctatctcaatataatctgctttgtctttaatcgcacgtgcataagacaaagcggtatgttccggctcaatcgcagaagagcccctgtgcgctatcaagacaggatgatagccggcggaagcatgggtgacggagcagcctccggaaatggaaagtaatgctatgaccgctaaatactttaattttttcataaaattaaagtatcatattctgcaggcgcacacaatgtttcattcttcacatcataaataaaaaactgcgccgtcatgatgtacacgagaggcgcagttcacccattacgaacttttcgtccaagccatcttctgaaatttgcggtaggctcttccgttgatataaaagaaaaatgacgtttttccgcttgccctgatcagctttcgcgcgaggcggcccatttctttttggccggcgactttgtcatcggataaatagacgccgagcagccccctgttgatcagccggtgaaaattttcatgcggaatgccttgcaaatgttcatccgctttttcaataaaatgctgcagtctctgcatcatttcttcatgagactgataatacgtacagaaattcagatcgccttcaagcagatcttcttcctggtcaattaaataatcaagcagtatatgcaggccttgtatgtacggaaaataactgctgcggattttctcagcggtatgttcgttaaaatcaggctggaatgagtaagcaacgagacagaaaatgcctaacgtcgatccggcgcaggccgagaattcaaaccactccatttccggaagctgcgacctgtactgctcaaaccaggctttaagcctcggaacccgttcatgctcaacgacatgcttatgaacctgaagatcgcaataataatcacacagttcaagcaaataaggtttaatgataccgtaatgttctattgacccgagcacccgctggcatgttctgaccagttcatgaagataaccgccgtcatcccgctcctctctgtactgatagtacggccgcacctcggcaccgaccgtcagcgcgtcacgcatggaaagatgaagcatgcggaagtcctccggatcaagcgaggtgctgcggtcgcacagattgtccagataatcactgattgtctgatacgcgatgataaattgcacgcatttctgtttctgctctcccgaaagcagggctaaaatgccgcctccttcacaatgaaacgacttatcgcggatacttgcggccgcctgctgccgcagttcggtatttttaatggaatctgatttttcccgccacatgttcaattcctgatgaacgagcggaaaaatttcccgatacacttttgccataaggttaaaaggatgttccggtactgtcaacatatgcaccccagcgaattcaaatatactgatctgtaaaggcttttgccgccttaaacacagtttctctttcaggttcattaaatatttcatgataaagcccttcccattcccggtacgatttattatgggaagccacaccggaaaaccatttgcggactttcattttatcgacgattttgtcatcaccgccctgcataagcaaaagcggcacctttaaaaacgcatcagtcggcaccatagcggcatcaatggtttttaaaagctctctgtaccatcttacggataccttcgtgacatataaagaatcgttttgatccgcttcaatcatatccgcattcctcgttgccatatcaggtgataagccggaatccactctgagggacggagcgaggacgttcagtcctttagacgcaaaatcaaggactttattgacttttatttgcagacccagacaaggtgatgataaaatgagtgccgtaatgcggggatttctctgctgcttaaaccattctatcgcaatcagtccgcccatgctgtggcccaaaaggaaaacgggcgcttcaagcgttctcgctttatcaatccatatatctacttcatcaatgtattcttggaaagagcgaatatgccctcgggcgcgggtcgacgttccctgaccgggcaaatcgcccatcaccacgttatatccggaagatctccacatttcaacgagccatttataacgcccgtggtattcgctcgccccgtggataatgacaatggtaccgacgggcctgtctgctttccaagtccacatgcagttcacctcttacataaatttagagaaagaaggatgagacatgataatctacccttataaacaatttacgcctgacgtacatcctgaagcgttcattgcggataacgccgtcataacgggcgacgtcgtgatcggagaacaatcgagcatttggttctcggcagtcatccgggggatgttgcgccgacaaggatcggaaaaagagtcagcatacaagacttgagctgtctgcatcaaagcccgaaccgcccgcttcttattgaagatgacgtcacgatcggccatcaggttacactgcacagcgcaatcatcagaaagaatgctttaatcggtatgggctccgtcattcttgacggggcggaaatcggagaaggcgcgtttatcggcgccggaagtctcgttcctccgggcaaaaccattcctcccggctgtcttgcgttcggccggcccgcaaaggttatccgccggctgacagaagaagacatacgggacatggaaagaatcagaacggaatatgttgaaaaaggccgatactataaaacaatgcaagagaaataaaaaagatcagctttgttttactactgtaccatttttcaaaatattatttaagtaaaaaccatttgcattctcccgattgtcaggaaacagaagcaaaatgttcaggaatttgttttattcttcccccttttacccgatcctatgaaaaaagagcccatttcagcgggctcttttttacgctttttcggcgaatgtctgtccgttttccagatctatgtcttttcttttatggaatcctttgccgtaataggcggctaataatatgccgaaccagacaggaccgatgatgacggccaccctggtctctgcatcaaaagccatcagcacaacgacaaaagccagaaatgccagcgagatatatgaggaaaaggggtataaaggcattttatatttgagttttttccgttcttccggctgtaagcttttacggtatttcatttgggaaagcaaaataatcgaccatgtccaaattgctccgaacgtcgcaatgctcgtcacccacgtaaacactttcgccggcaccacgtagttcagcaaaacgccgatgcataacgcacccgctgaaaccaataccgcttttcccggcacaccgccttttgtgaccgtaccgtatgctttaggcgcttcattttgctccgccagattgaacagcatacgccccgtgctgaagatcccgctgttgcaggaagaaagagccgccgtcaatacgacaaaattaatgattccggctgcagcgggtattccgattttttcaaatgtcaaaacaaacgggcttccgcctgaaccgatttcctgccacggataaattgacataatgacaaacaaagctccgacgtaaaaaatgagaatgcgccaaaaaacagtatctatggcccgcgccagtgatttttccggatttttgacctcaccggctgtgacaccgatcagctcaatcccgagataagcaaacatgaccatctgaagcgacagcagcacccctttaatcccattcgggaaaaagccgccgtggctccataaattgctgattccgagcgcaacgcctccgtttccgagaccgaatacgatcatcaccagaccgatcgcgatcattgacagaatcgccaagactttaatgagcgcaaaccagaattcaagctcaccgtacgctttgaccgccagaaagttgacagccgtcataatgacgagtgcacaaagcgcccagatccatgacggcacgtcagggaaccagtagcccatataaatgccgaccgcggtgatttccgccatgcaggtaacgacccataaaaaccaataattccagcctgttaaaaacccggcaagcgggccgatataatctctggcataccggctgaatgaaccggctacaggcttttgaatcgccatttcccccaatgcccgcataataaaaaacataatcagtccgctgcaggcgtaagcggctaaaatccccggcccggcaagctttatggcagaagcagacccgagaaacagcccgactccaatcgcggcgcccaacgacataagcgagatatgccgctcttccaagccgcggtgaagcgttttttctttgttttgcataactctccctccccctgattttgacaaagaaacaacaaaccgagacgaaatagccagaaaactttttccggaatctacccgattagtcctattataacctttttctgaatattgcgtaatactttgtcgaaaacagagcggaatagacggtttacaaaaaacaatagaaaaaaggctttcgataactcgaaagccttttggattaaacgaaaatgacttctttcggctgatgattcagctcttccggcaccagtcttttttcgacattgatgctgtgccagatcatgaagatcagcacggtccagattttgcggctgttgtccgctctgtcggcacaatgatcttccagaagctgaaggacataatccttttcaatataagcgtctgtttcactttcgcgaatgatgttgcgaacccattcgttcatttcatttttcagccagtggcggatcggcacagggaagccgagttttttgcggttaagcacatgatcaggcactaccccttcagcagctttgcgcagaaggtatttcgtcgtgccgtttttcgttttcaattcatccggaatttttgaagctacgtcaaacacgactttatcaaggaacggcacgcgcagttccaatgagttggccatcgtcattttgtcagcctttaacaggatgtcgccgcgcatccacgtatggatgtcaacatactgcattttatttatgtcgctgtatgaacggctttccgtaaagtacggcttcgtgacatcacggtatgaaagctctggattgtaatgtttgagcagctgttttttcacgggctcttcaaaaatcttcgcattaccgatatagcgctcctcaagcggtgtgcagccgcggactaagaggcttttccctctcattccttcaggcatgacggacgccacatgaagaagcatttttttcagaccggacggaatgcgttcaaacggtttaagcgaaagcggttcgcggtaaatattgtacccgccgaacagctcgtccgcgccttccccggataacgcgaccgttacatgctttttcgcttctttcgcgacaaagtacaaaggaatcgccgccggatctgcaagcgggtcatcaaagtgccagacgattttcggaagctcgttcatatactcctcaggagaaatgactttgctgatattttcaataccaagcgcggcagccgtttccttcgctacgtcaacctcactaaagccctgctgctcaaaaccgacggaaaatgttttaaggctcgggtgaaattctttcgcaactgaaacgataaaagaagagtcgataccgccggatagaaacgaaccgacaggaacgtcacttctcatgtgaactttgacagagtcaaagattgcgtctctgacttctttcaccaatttatcttcatcagactgaacaggcttgaagttcgctttgaaatatgttttaaacgcgatgtcgccttccgggcggatcgtaaactggctgcccggctcgacttttttcacttcagcgtcaagcgtgctcggttcaggaacgaattggaaagacatatattgctgtaaagaagctgtatcaagatcaataccgttttgagcggccattaaactctttctttcagatgcaaaatatactttgtccccgatggttgtgtaatacagcggtttaattccgaacgggtctctcgcgccgtacatgacgcggtcagctttgttccagattaaaaacgcaaacattccgcgaagctttgaagcggcttcttctttataatgacggtatgtcgcaaggagcacttcggtatcggaatctgtattgaaagtgtagcctttcgcttcaagctcttctctcaattcaatgtagttatagatttcgccgttaaaaatgatccaatatttttcgtcttcatatgataaaggctgtccgccgttttctacgtcaataatactgagccgtctgaagccgaatccgacgtgctcgtcatgataatacccatcgctgtcaggaccgcggtgaacgatcatttggttcatttgtttgattagctcttcttgatctgcggtttgagttaatggatgcttattaaaaacaccgacaaatccacacatagtatagcctccataagtgtaattttctaattggaccccctttttatagacgctttgttacgccattggtttcacgctatgtaaaaaataagcatggcagcatctacaaaaagggaaagccgcttaagtaagcggctataaaattattctcctagtgcttctttgcgaagcgcatccgccttgtcagtacgctcccaaggaagatccacatcatgacgtccgaagtggccgtaagcagctgtctgcttatagatcgggcggcgcagatcaagcattttaataatgccggcaggtctcaggtcgaagttattccgtacgacttcgatcagtttttcttcagaagcttttcctgtatcaaatgtattgatggaaatagaaacaggctgtgccacgccgattgcgtatgcaagctgcacttcacaagaatcagcaagacctgctgccacgatgtttttcgctacgtatctcgcagcgtatgccgctgaacggtctaccttcgtcgcatccttaccggagaatgcgccgccgccgtgacgtgcatatccgccgtatgtgtcaacgatgattttacggcccgtaagacccgcatcaccttgaggcccgccgattacgaaacgtcccgtagggttgatgaagtattttgtttcttcatcgatcagttcctcaggcacgacagggttaatgacatgctctttcagattgcgctgaatctgctcaagcgtaatttccgggtggtgctgagttgaaataacgatcgcgtcgatgcggaccggcttgttgttttcatcatattcaacggtaacttgcgttttgccgtcagggcgaaggtacggaagaatgtcttctttgcggacttcgctcaaacggcgggctagtttatgcgccaaagagatcggaagcggcataagctctttcgtttcgttacacgcataaccaaacatcaggccttggtctcccgctccgattgcttcgatttcagcatcgctcattgtgccttcacgcgcttcaagtgcctgatcgacacccattgcgatatccgcagactgttcatcaattgatgttaaaacagcgcaagtctccgcatcaaatccgtatttggcgcgtgtgtagccgatttctttaatcgtttcacggactgttttcggaatgtcaacgtatgttgacgtagtaatctctccgcttaccagcacaagtcctgtcgttacagatgtttcgcaggccacgcgcgcgttcgggtcattttttaaaatctcatctaagatactgtcagaaatttggtcacagattttgtccggatgaccctcagtaacagattcagatgtaaatagtcgacggtttttactcattcacttttcctcctgaaaaaagatcttttgcaagaccttctcatatgatacggaactcgctccctcttaatacaatgtcatactatatcagagaatgttaattggcatattttatgaaataaaaaaaccttttccactcgaggaaagggtttggtctgtgtgcctttcactcttatcgctcaaggaaaatattaaaccttgcatcaggttagcaccttggtttcccacagtgttttcacctgcttttttacagagaaaccggttgctgggcttcatcgggcctgtccctccgccagctcgggataagagtatccgctcaatgaaatatcttatcgtaaaagggcggaaagtgtcaatatgaattaaagcgattgcgcgcctttatttcgggaagcaatggaaaaacacaaacaaaaaaccgtaaatagtatagactattttcagatatatgttatactaattccacattcagcgaaatacaaataaaccggcaaaggaaggtttttatgaaattagttgatttaaccgcagatcttcaagcattacttgcaagtccgaatgtgcatcataatttatcggctccaaaacttaccgaaaaagtgatcagccgaaatgaaggaacgctgacatcaacgggcgccgtacgcgccactaccggcgcatatacaggccggtcacctaaagataaatttatcgtccgtgaacaaagcacagaaaatcaaattgattggggcgcggtgaatcagcccatttctgaagaggcgtttgaaaagctgtacgccaaagtcgtcagctacttaaaacagcgggatgaactgtttgtgtttgaaggattcgcgggagcggatgaaaaatacagactgccgattacggtcgtaaatgaatttgcgtggcacaatttattcgcgcgccagctgtttatcagaccggaaacggatgaaagagacccgcaagcgcagcctttcaccattctctcagctccgcattttaaagcagacccggagacggacggcacgcattcggaaacatttatcattgtctctttcgaaaagcgcgtcattttaatcgggggcaccgaatacgccggagaaatgaaaaaatcaatattctccattatgaacttcctgcttccgcagcaggatatactgccgatgcactgctcagccaacgtcggtgaaaaaggcgatgtcgccctgtttttcggcctttccggcacagggaaaacgacgctttcagccgatgcggaccgcaaactgatcggagatgacgagcacggctggtcagattccggcgttttcaacattgaaggcggatgttacgctaaatgtatcaatctgagcgaggaaaaagaaccgcagatttttcgtgcgatccgcttcgggtctgttcttgagaatgtcgtgcttgatgaaaaaacgggtgaagcggattacgacaattccttctacacggaaaacacaagagccgcatatccgattgagatgatcggcaatatcgtgcagccgagcattgccggccatccgcaggcgatcgtctttctaacggcggacgcattcggcgtgcttcctccgatcagcaaactgacgaaggaacaggcgatgtatcacttcttaagcggatacaccagtaaactcgcgggaaccgaacgcggcgtgacatctccgcaaacgactttctcgacgtgcttcggttcaccgttccttccgcttccggcgcatgtatatgccgaaatgctcgggcgtaaaatcgacgaacacggcgttcaagtcttcctggtcaacacaggctggaccggcggagggtacggagtcggagaacggatgaaactttcgtatacaagagcgatggtcaaggccgctattgacggcagactgaaccagactgacatgacggcagacagcattttcggcctgcacagtcccgttcatgttccgggcgtgccggatgaagttcttcagcctgaaaacacatggagcgataaacaagcatacaacgaaaaagcgctgtttttagccaatgagtttaaagaaaactttaaaaagttttcccatgcagactcgattgccaaaaccggcggacctctcgtgtaatcaaaaaagccaagggcgtttatgccctcggcttttgttttttcagtttgtcgaatgaagcgaagtgagtctgtatgtaatgcttgtccggccgttcgcccattcgagcttctggacctcgccggtgccggatttctcgccggttttcgttttgcgcacgtccatcggaatatcaagaggatagacgcggtagccctctttctccaataaaaagatattttcctctatccgtttttcattgccttttgtcacaatcatggtattaaattcaacaggcattcccaaaatgaaaatcccctttcattctcttattctttattatcatatcataaatcaggcatcttaccgtgtcttcatccattccgccagccgccggacaatgcgtctgttttcctgcggcggaaaataatgcgtaaaaccgctgtaataccaagtttccaccggtttccccgcctctttcagcttgtcctcgatcatccgggcgtgttcgatcgaaacattttcatcattctctccatggatgagcagcacaggggcctgaatgcggtctgctttttcaaacggcgaacgccatctgtattcatccggcacctttttcggcgtgccgccgatcacccgcttcatcatccgccgcatatccttccgctcttcataagtcagcaccatatcgctcacaccgccccatgaaacgagtgaagccgcttgatgccccatttcaatcgcggtcaaaagccccatgattccgccccgggaaaaaccgaaaatatgcacccgcccttccctgacgttcggatgctcccgaagcaggcggaaagcggaaaacgcgtcctctctgtcctctcccgcaaaatcttcatttccctcgccgccctggttgcctctgtaataaggcgcaaacacgacaaagccttgggaagcgaattgaacgattctcccggggcgtaccatgccgacattttttatgccgccgcgcaaatataaaaaaccgtcatatgttcccggcgccgcaggctcggcaaggagcccctttaccttcagcccttctgactcatagcataccgcaaagaggcggacatgcggactcggagacgggaaccttttcttttctaccagcaaaacaatgcgcctccttagatcatcagtttttttattctttcccaacgtgaatatgggcactcacacattttttatacccatcatacgatatgtaaagcagaaaaggttattttaacgcttaaaacaaggaggttacaccgtgaacaaatggctcaaagcgggctgcgtttttgtcatatgcgcctttttcctgctcattcttccggcttgcagacaggaagaaagtctgacgaaggtaaaggtggcggaagtcacacactccatcttctatacgcctctgtatgtcgctgaagcaaaagatttctttaaaaaagaagggctccaagtgtcacttcaaacaacatggggcggagacaaaacgatgacatcgcttttgtcaaacgggtcagacatcgcgctggtcggttctgaaacatccatttacgtggaggcgcagggagcaaaagatccggtcatcaatttcgcgcagctgacgcagacggatggcacatttctcgtgtcgcggaaggatgagaaatcattcaaatggaacgatttaaaaggaaaaacatttctcggccagcgaaaaggcggcatgccccaaatggccggtgagtacgtcctgaaaaagaatcacatagagccgaaaaaagacattaacctcgttcaaaacattgatttcgccaatatttccaacgcattcgcatccggaacgggtgattatgtgcagctgtttgaaccgacggcatcccaatttgaaaaagaaggcatcggtcatatcgtcgcatccttcggagaagcttccggccaagtgccatacacaacctttatggcaaaagaaagttatttgaaaaacaatgaaaagacggcggaaaaattcacccgcgccatctatcgcgcccagcaatgggtggaaagccatccggccaaagacatcgcaaaaacgattcagaaggaatttgccgatacagacccggccattatcgaaacatcgatagagcgctataaaaaacaaaagtcattctctgcagacccagttctgcaaaaggatgaatgggaactgcttcaatctattatggatgaagccggagagctcccgaaacacattccgtacagcaaactcgtcaacacaaaaatcgccaaaaaagtcacctcagaacaataggaggaacatgaatgtcttttttacatgtggatcatgtaacacatacttatttctcgcttaaagaaaagacaaccgccgtgaaagatatacattttcagattgaaaaaggggatttcatctcctttctcgggccgagcggatgcggaaaaacaacactcctgtccattctggccggccttatcacccctgcgcaaggccgggtgctgatcgaaggaagcgtgccgaaccataaagaacaccaaatcggttatatgcttcagcaggattatttatttccttggaaatcgattgaggaaaacgtgctgctcggtttacacatttcaaaaacattaacagaagaaaaaagagctgaagttctcagccttctgcctaagctcggattaatcggcgttgaaaagaaatatccgaaagagctctcaggcggaatgcggcagcgggcggcacttgccagaactcttgcgccggaccctggactgctgctccttgatgaaccgttttccgcgctggactttcaaacgaagctttctttggaaaaccttgtcttcagaacattaaaggattttcaaaaaaccgccgtgctcgtcacccacgatatcggtgaagccatcgccatgagcgatacgatctatttattttcgaatcagccgggcaccatccaccaaatattcaccgtgcctaaggagctcgcggctttagatccgtttgacgcgcgtcaggatccggcctttcagccgctgtttcaaaccatatggaaggagctgaattcccttgaaaaacagcagcggcacgattgaacagcttcatcagcagtttaagaaaagacaccaaaaagaaaagctccggatccgtgcgtatcaggccgccattttcatcgtattttttgccgggtgggaaatatcgagcagggcgggctggatcgatccgttaatcttcagctcaccctccgccgtttgcaggcttttagttgaaaagattgcggacggatcccttgcggcgcacatcggcgtaaccttaggagaaaccgttctcggctttttgctcggcacgcttctcggcacatgcctcgccgctctgttatggtggtcaaacagactcgcccgggttttagacccgtacctcgtcattttaaacgcgatgccgaaggtcgcactcggaccgattctcatcgtggcactcggaccgaatttcacaagcattgtcgccatgggagcagtcatcagtgtcattatcacgacaatcgtcgtctttacggcttttcaggaagtggatgaaaactatattaaggtgatgaaaaccttcggagcgaaaagaagcatcatgtttaaagaagtcattctgccggcatgcgcccccgcgattatttccgcgcttaaagtgaacgtcggtttatcctgggtcggtgtcatcgtcggcgagtttctcgtttccgaaaaaggtctgggctacatgatcatttacggattccaggtcttcaatttcactcttgtgttcttaagccttctgatcatcgcgatttttgcgacattgatgtatcagggagtcgaactgttagaaagaaaatggacgaaaggaaaaatataaaaaagacccgtgcgtaagcgccgggtctccgttttttatgattgaaatacgccgtcctctttcagctttttcagactgatcggaagcaccgaatctttcataatgaaactgaattttttatttcgggggagattctccggcagttcgctgaacagcaccggcccctttgtttcaaaatagtcagcctgtttttcaagcttttcaatatcggcaaaataaatattcttcacgattaccttttccctgccgagaactttatactgtccgacgtacttcagatgtcttaccgcggcgccggtttcttctttcacctcgcgcagggccgcttcctccgcacattccatcggctccacttttccgcccggaaattcaaacccccggtcttcgtgctcagtcaaaagccacttatctccatatcggcatatgacccatacatgcttcgggctgtctgaaaaaggctggtgttcaaaggagagctgaacagtattctgataatagtctttaaactcgtacatgtttatccctctaatccgttccttcatatcttccatacatcataccacagttgcgtttgttcggaagccctttatcaaaaattcagaggaaaaccatcatacccgctagtatagcctcctttgaagcaaatgttacggtttgcgcttgaatttatttttcaaagtatccaataggtcgacgagcacctgcggaaccgggatgcccagcgagcttgccgtaatcacgatctgaaccgattcgtataagatataaaacataatagccaaattgcggatggcgccttctgaatgaagcagctgatcaaaaaaatggcaaactgagactaatgccagggtcacgatttttttgaccagccgcgcaaaaagctttcttgcgctcagctgctgcaaaagagattcttttaagcttgtactgataaactcaatcgccatgaccgatagcaaaatcagaaacgaatactgaaaaccgccaaagaaaaaccccgctgccgacacgatcactgcaaaaaacgaaaagatgccaaagtctttgcccacttgatccaacatcctttcacagaaacggccttacattattctatgaaaagtgaatggaacggactggatttttcagaaaaatggacaacacctctcttcggcagccaaataaaagaccgagtgctttatagccccggtcttcccttgttgattatcctaaatacgctttcagcatccaattatgtttttcgatattctggtgaatggcaagcagcatatctccggtcgtttcgtctccgacctcatctgcgagatccatgccgcttttcagctcttccgcaatgacagtgaaatcatcataaatgttctgtaccatttgttctgcgctctcattgccttccgcctcttttatagaagcactcttcaatgattccgtcattgtgccgatcggcttgccgttcaatgccagcagacgttctgccagatcatcaatatatgtagccgtttcgttatacagctcctcgaacttttcgtgcaatgtgaaaaagtccttccctttgacgtaccaatgatagttatgtaatttcacatacatgaccgtccagtttgcaacttgtttattgaccgcttccaatagtttttctgacatgcctatcttcctcctttgatttactattgatataccctatatatcgtgtgttaaaacataaatttttagcccttgattttacggatggaaaatatgttatgatttgttaaaaaggagggatttcatgctgcttcttctgagcttcggctttcttatcgtgctcgccgtgctgcttttatccatctggtcgactgtaagagcttataacgtaaaacatacgattgacccgccggaggacgcatcaaaaggcttgacggataaaaacaatccttaatgatgatgcgtctgttcctcatggccggaggaatcatcggcagcttcagcatccccgacacgtacttttacagtcggcatattatgctgctgttttgccgttacgtgggattgaacggtatacacaccctcttcatcaaattcagtccgcaggtgatacgcccctttttcctccttggccttgcttgttttgctgctgcctttttttccttctttccatacttcaaacatgacttcatccgcatccgtgacacgcttgccgccgtaaaaaacctccgccttgtattccgttttttcatgcggtgctgccgtttccggtcctgtaagcttgacctcaagcgctttaggctcctcatccgcggcggttttgtccgaattgcccccgcaggaagataatagaaataccataccgcacatacctgccaatacagcccgtttcatcccatcactccttcatgtttgcttctattttagcaaacgcttacacataaggtgtgacattttttagaaatatgtaaaaaagcctttttgcatgtcagcaaaaaggcctgttttttatccgaacactttcagcaaatcttctttatcttgtgacagccagaaacgcatcagccgtttcgcgccttctaaatcatgaagtttcgcctggccgcactgtttttcgttggccgccggaatctccgtaatatcgatggcttctttcagcgtagcgtctagcaggtctacaatttcttccgctgtaggctcgccgctgacaacaagataatagcctgtctggcagcccatcggtgagatatctatgatgtcgaagtgatcgtatttctcagaatgtgtgcgaatcgtaaacgcaagcaagtgctcaagcgtatgaatcgtatccggcttcatcgcctgtttgttcggctggcagaagcgaatgtcaaacttattcacgacgccgtctgttccgactttatgcactccgcaatgtcttacatacggagccacaaccgcattatggtctagctcaaaactttctactgaaggcataatggcactccctttttttcagaatatgcatccattataacacagttttccgataagaattgtggcgaaagcttttcaatctgaaattttttttctatactagcatcagaaaggtggttttttaatgaaaaccataatgattgcgctcatccgcggataccagaagttcatctctccgctgacgccgccgtcatgccgcttttatccgacgtgttcacagtacggaatcgaagccgtcaagactcacggcgcattaaaaggcggatggctgacactgaagcggattttaaagtgccacccttttcatccgggcggtgttgatcccgtaccggacaaaaaacgaaaacattagtccatatgctggtagccgtcgatcaccagatcaagtttaccggtttcaggatcaatcaccagaccgtgcaccgggacattgtcagggaatagcggatggtgtttaatgacgtttacgctgtctgtaacactcgcttctactgaatcaaagcttttcagccattgatcaagatcaacacctgagtgcttcagcatgtcaatccgctctttcggaataccgcggtcgataattttatcaagcatatcctcgctgttgattttgctcatgccgcaatcatggtggccgataacgcagacttcatcagcgtttaattcgtatacggccactaaaaggctgcgcatgatgcttccgaacgggtgggcgacaagcgcgccggcacttttaataattttcacatcgccgtttcgcatgttcatcgcatgcggaagcaattctacaagacgtgtgtccatacaggacaaaattgccatctttttatccgggaatttagatgtttggtatttttcataatctttgtttttagtgaactgctcattaaattgcatgatatcgtttagaagactcatcttggtgtttcctttctgcttttttattcacaatataacataaggcgggtcatttcgtcactccccgcacgagatgataaagtgctcaataaataagacaaaccctattgggcttgtcttatttccccatattgtattttttgttgaactgttcgactctcccgcctttttcgttgaatttttggcggcccgtataaaacggatgcgtatctgagctgacttccactttaatcagcgggtatgtttttccgtcttcccactctgccgtttcctctgacgttttcgtagaatggcttaaaaagcggtagccgctgttcacatcttgaaaaatcacttggtggttatccggatgaatatcttttttcatggtgatctccctttcttaaatcgtaataattacgttttattctaaaccttaaataggcgcttgtcaatcatatatgccctgatcccttgatttctaaaccctgcacatatatggaatcggaagaataatctaatcgcttcagcaaataatataaccacattacataaaacggtaatttagaaaggcggtttatgatcgtggatgatttagtattagccagaagtctgttcgggacaaccatgggctttcatattatttttgcgacgcttggtgtcggcttgcctctgatgattttaatggccgaattgatttatcaaaaaacaaaagatccgcattatgccattatggcgaaaaggtggacgaaggcgcaggctgttctgctcggcgtggcgataccgaccggaacgatcgcgggtacacagcttgcccttttgtggcccggattcatggagatcatcggcagggtgatgtcacttccgtttcagattgaaatttatgctttctttatcgaagcgctgtttatgtccatttatgtctacgccgctgaccggctgactccggcgatgcgcatcattgccgttattttcgttttgatcggcgccgcggcatccgccgtcttaatcacaaatgttcacgcatttgaaggaacgccggccggctttaaaattttaaacggcaaaatcactgacgtcgaaccgtgggcagcgttttttaatccaagctttttcaccaccgcgggccatgtcgtactgacggctttcatgaccggtgcatttatcgtcgcgtcagttgcggcttataaaatgctgagaacgagaaaacaggagcaggtataccgctttcaccgaaaagcgctgctgctcgctttaacgatcggcgggatattctctattattgcttctttaaacggtcacgagtcagcccagcttctttacgaataccagcctgagaagcttgcgggcgcagaagggctgtttgaaactagatcacacgctccgcttgcgatcgggggttttactgatgcaaaagaagaaaaagtaaaatgggcgatagaagtgccgtgggctttaagctttttggccgcaaacagctttgataccgtcgtcaaaggattgaacgcgtttccgaaagacgagtggccgcctttattcatccatacactgtttaacggaatggtcggcatcgggatgctgctcattttgtactccatcatcggcatcgtgtggagaaaaattttaaagaaagacagctttccgacttggcttttgattttatttttaaccgcaggaccgctcagtctgatcggaattgaattcgggtggatattcgcttgtacggggcggcagccatgggtgatttaccatctcctgaaaacgtctgatgtcgtcacgacaaccggttcaatcggtttgctgttcatcctgttcacagtggtttacgccattttggcagccgcagtcatttatgtgctgctttattatttccgcaaacatcctgttgaggaggatgtaaaagcggcggaatcctaacaatagaaagggctgaattgaaatggacattaccatggatgctctcattgcgatatcaatcgtatggggcttcgtgtttatctacgcggtcatggcaacgatggacttcggagccggcttttggtcgatgatatatttaaataaagaacaaacaaaggcgacaaacatcgccaaccgttatttgtccccgacatgggaagtgaccaacgtctttatcgtcgcgatcgttgtcgccctattcagcttctttccaggggcaaccttcgtgctgggaaccgttttattgatcccgggaagtattattttgctgctcttagccatccgcagcggctttctcgtcttctccaatacggcgaaggaaagaaaaatcatgagatatatctccggaatttcaggcttcattattcccgctgtgctgattttggtccttccggtcacacacggagggtttattgagaagacgggcggagtgtatcacctgaatttggcaaatgtctttacaagtcttaatgcgtatgcgtttatcggctttgccattttaagcactttatttttatcttcactgcttctggccgatttttcaaatgttgcggaagaggagcatgcgtaccgcatctacagacggagctctttaataacagggccgctgtcgcttctgtttgccttcttcattatgctgacattacgctctgaagccggctggctgtatacggggatgatgaaagacaagacatggctcattctgtctgtcattacatttatcattgccggcgtggctctgtttttgccgaataagcgcttcggccgcaacctcggcaaaccgagaatcgccatgatcgccattgcgctccaatactttctggcaagctatgcatacggacgggctcatcttccttatatgatttatccggatattacggtcatgtcaggatttacggagccggcaaccttcagggcgctgtttatgacgtatatcgtcgctttcatcattttgttccccgggttttatttcttctggaagctctttatgaaagacagacgttatatccgccaggaggaataacaaaaatcagggcggctcatactaatggcgtaccttttatcttggaggggagccagcatggaccaaaaaattctgtgtgaagtcaataactgttcatattggggcagaggaaacaaatgcacggccgacgctatttatgtggtcagccatacaggcgaaaccgctgaaaaaagtgaagaaacggattgcaaaacctttaaaccgcaagatttataaaagaaaagagctgttttatacagctctttttcatttccgccgcaagcctccctgagccggagaaaaccgcgcggatgagaagcatggcaaaaaggcggttcggcggcaaatataggcggcagacggtacaatcagtatcgcattcatgacaagctcagaattttttatcaagatgtacatgtttgccccagccggaaagcagcacctgcgttgtaaagccggcactgtttgaagaataaaaaaatcatcgcatccgcctattaaaaaaaccggctgatacagccggttcaaacgggggaaggggtgataatgaacagcttcaatataacagcagcgtacaggcagctcaactcgctgaaatgtctttttatcagttgtttgtcgtaaaaacgtccatttgggtgacgtattttctcattatttcctgattgacttcaacacctagtccgggaccgtccgggacagagatgaatccctcttcgatacggatatcgggagtgacaatatcctcctcccagtatcggtctgatgaggaaatatcacccggtatcgtaaattgcggcagcgaagcaagcgcgactgtctgcgctctcgaaatgccggtttcaaacattccgccgcaccaaaccggcatgtgatgctctctgcataagtcatgtatttttaatgcctctgtcaggcctcctacacgcgccggttttatgttaatgattttacagctcccaagctcaatcgcccgccttgcgtcatcataagagcatatgctttcatcaaggcataccgcggttcttaagtgtttctgcaggtggcggtgatcgacaatatcatctgcctgaagcggctgttctatcatcatgagctggaattcatccaactctttcagcctgctgatgtctttcagttcataagccgagttggcatccgccatcagcggcacgttcggaaaacggctgcggatggctctgaccagatcaacgtcatggccgggctgaatttttatttttatacgttgataaccttcttttacgtattgctcaatttcccgaagcatctcatcagccgaagccagacccaccgccacgccggcgggcactttatctcttttgccccctaaggcttctgcgagagatatcccctttttcttggcatatagatcccacacggctgattcaagccccgcttttgccatgcggtttcctttgaaacgcgcgagactgtcaggcacttctgacggatggaaaaacgcgcggcctacgacatttgggatgaaaaaatctctcagcatatgcgcgcatgtctgaatcgtttcttctgtataccacggagaagaaaacgccgatacctcccccagccggttctcccggtttcgtcgatcgcttccacgatcaaaaatttacgatcctgcagcgtttcaatacttgttttaaacggttttttcagcctcatacttacatgataaagggtgattttttcaatcttaatcatgacaattctcctttacgaagctcattcagccgatgcctcatcagtttattggacgcgttccgcgggagcccgtcaaccttgaaaaaagcagctggtattttatattttgcaagccgctcacggcaaaaggcggtcagctcctcagaactgacagaagaagtcagcacgagaaaagcatgcggcactttcccccacttcggatcttcggctcccgaaacaccggcctccgctacagccggatgggcaagcagcgccgcttccacttctgcggggtagatgttctctccgcctgaaatgatgaggtccgaccgcctgtccagcacgtataaaaacccttcatcatccaaatagccaagatcgcccgttttgaaccatccattatgaaaagcggcctggttcgcgtcgtcacgatgataataccctttcattacattcgggcctttcaccgtaatttcaccatgttcaaacggcgcacaagggtttccgtctttttcaattctaatttcgcatgaaaacagcggtttaccggccgagccgagcttgtccatgctgaattccggagaaagtgtgacaatctgtgagcaggtttcagtcaagccgtaagattggaataccggaaattgtttcctgcggcattcttcaaggagcggcagcggtgccggacccccgccaagcagaatgcagcgcagtgattcaggacattgttcagtttccgcaagcaggcccgagagcatggtctgcaccgctgaaatgatcgtgacctgatgggagctgatgctgtccagcacatcagtgacagagaatttttgatgaagcacgacgggcatgccgtaaatgaccgacttaaacagcgcagacagaccgctgatatgaaacagcggcagcgcaataagccagcggtcccgctccgtgacccccagattcagcgcagacgatacagcgctggaataatgattaccgaaagtctgctgcacccctttcggccttcctgttgttcctgacgtatacataagagtcgccgtatcatcaagcgttacataagcttccggctccatgtcacccgcctcttcagcctgcagctcgtccacatctgcggtggcgaccgcagattcatattcttcgcggcaaaaaccgtcctccgtcaataaaagctttgcctgtgaatcttcgagctgaaacaaccgttcctgttttgagagcttcgtattcaacagcacagcttccgcccctaataagaagcaggcgtgaacggcataaaccatttccggtctgttagaaagcaaaatcgcggccctgtctccttttttaagcgagcagtatttggacagccgcgcggccatttgtttagaagcatgatataattctctgaatgtcatctgtttgttttcaaatatgagagcgattctctccggtgtcagctgagccctttgaatgagccaattcggctgttctgtcagcatgttatcatctccgaggtaaaagtactgtttttgaaaagaaaacagcttggaccagagcggctcaagctgtttcgtagtgtcatctgatcacggaaaacgagggaattgaccgaaatcgggactgcgtttctctttaaaggaatcacggccttctttcgcttcgtcagtcgtgtaataaagaagcgttgcatctcctgcaaattgctgaattccggcgaggccgtctgtatcagcgttaaatgccgctttaaggaaacgaagggctgtagggcttttctcaagcatttcttcacaccatttaattgtttcctcttcaagtttctctaatgggacaaccgtattgacaagccccatgtcgagcgcttcctgcgcgttgtattgacggcacaggtaccagatttcacgggctttcttatgtccgacgatacgcgccaggtaacctgagccgtaaccggcatcaaagctacccactttcgggccggtttgaccgaaaatcgcgttatcggccgcaatcgttaaatcacagacgatatgaagcacatggcctccgccgatggcatagcctgataccatcgctacgaccggtttaggaatcacacggatcaaacgctgaagatcaagcacattcagacgcgggatttgatcgtctccgacatatccgccgtgaccgcggactttttggtctccgcctgaacagaatgctttatctcccgctcccgcaagaacgatgacaccaatattggagtcatcacgcgcacaagcaaacgcgtcaatcatttctgataccgtcttaggagtaaatgcgttatgtacctccgggcggttaattgttatttttgcaataccgttatacgtctcgtacaggatttcatcgtactgacgttcacttttccattctgcagccattgatatgacctccttcatttttgcctgagtccggccgaaaagctattttctttatgctttacaagccgtataaaaactcacttactatcttaccaaaaattcgcggctgttccacatgtaccgtgtgccccgcctgtttgacaacctctattttacttgatgggagcaggttatgcaccttttgattaatagcgcaaaacttttcatcccattcaccgcatatgagcaggacgggcgccttgatgcggtgtaatgcctcccaccaggaaggctgtgagcctgtccccattccgagcaggcttcctgcaagtccggacggattattcttcagcctgccggcacggatggacgcctttacgctgtccggaagagaaagctgcgtggcaaacaacggaatgctctcccaataatcaacaaacgatgttacaccttcccgcaatataaagtcagcaagcttccggtctgactgaatccgttttttgcgttcctgaagcgtgctgaggcccggggttgtactttccaaaacaagcgctgacacccgatgcggaaatgcctgtgcaaaggaatacgcaagtcttccccccatagaataaccaataagtttcactttgtgaagttttaattgatcaaaaacggcggcaaggtccgcaacctgccggctcgcactataccttgccgcttgcacaggcgcgtctgtctccccgtgacccaggcagtcaatcatcaccattcgctcgccgggaaacatgccgcgtaaaaacatccatgattctttgctgcccgtaaatccatgcagacaaacaatagcttcagacgattcgtgtccgtgtccgctatcagcagcacgatagcatacgccgtcggccgttttaactgttacagtttccattcttttttcacttcccgcactgcggcctgcagcagatcgcgatggaattgaactcttgatgtccgatctgttttcagctcgattatatgaagtccgggcttgtccgcctgcggctgatacgcatccttaaatgcttcccatgtctcaggacaagtatacgtcccgccatacagtgcggcggcatgccggaaatcaagacccgtcggcgtaccgaacagttcttcaaaatgagtcttatcagatgcctgcggcaaaaacgagaaaatcccgccgccatcattgtttattaaaataaccgtaagcggaattccaagttttttagccgctaacagcccgtttaaatcatgataaaacgataaatctccaatgacaagcgtgacaggagcttttgtaccttcacacagtcccatagccgaggagacaactccgtcaatgccgttagcgccgcggttggcatagacacggaaggaacgatcttgtttttcaaagaaagtatccacgtcgcggatcggcatgctgttgccgacaaaaatcgaactgccttcagggacaaggtgctgaagctgacgatatacatttccttcaaatgataaatcatccatgctcgcggcctgtaaatgactccggaaccggtcattgacaaattgccatttctcaagccatccggacggccgttttccggtttcagctgaacggaccgcttccaaaaacacagacggatggcaatgaatcatatgcgcgccggcctgggtgggatctctccatcctccgtcttcatcgacgataaactgctcaatggcaggatcgtctctgagccataaaaagagcggtttggaaaccggcatcggaccgaagcggatcacagcgtcagggcgcagcgcctcttttatttcttcatcttttaagaacgagtcataagcatcaataatcagcgtcttatcatgctccccgtttcggaggtttgaaagcggatcagccaaaatcgggaactgaagcatctcggcaagcgcgatgatttgctgcttttctgcttcaccgtgaatttcgccgcagacgatcatacctctttcggtacccgcgagacgctctgtaatatgacagagagagtcttgatcagctgactgaatccctgttgtgactgagacgtgcttcccctttctcattctttcaaaaggtccggctgataaatccggcatcaaaggctctctgagcggcacattgatatggactggccccatcgggcgcttcccggcttcacttacggatctgccggccaatgttctgatatagctaagcatttgaggtttttcctcaggaagagctgagtctgtgaaaaacttaacaaagttaccgaacagaaaatgctggttaatcgcctgaggcgcccccacttccctcaattcatgaggccggtcagcagtcaggacaataagaggcactcttgaataatgagcttcaatcacggccggatagaagttagccgctgccgttcctgacgtacaaatcagcatgaccggacgctggcgggcttttgcaagaccgagtgcgaaaaaacctgcggatcgttcatcaatctgtatatggacttgaatatccgggtgggccgccgccaaaaccgccaggggagttgacctcgatcccgggcaaacaaccgcgtcggtgacacccgatagcgcgaattcatcaataaagcttccgatataatgtgtaatcgggtttgtcaaagcctttcacctcctaaagcagagatcatcggctttagtttaatttgtgtttcttcatattctgattgcggatctgaatcttcaacaatgccgcagcctgcgaaaagccgcgcacttttgccttcaatcagccctgatcggatagccacgacaaattctccgttttccctgccgtccatccagccgatcggagccgcataccatccgcgtgtcatcggttcaatatcagcgataacttcaacagctttctgctgaggagctcctcccaatgccggagtgggatgcagcttttcaattaaatcaaacagcgaagcggacgttttcagattgcctgtgatcggcgtatatagatgctgaacactttttgttttatataattgcgggcctgcaggctttttcacatcactgcagctcgacaagaaagaatcgtgtatcatcttaaccacaaaatcatgttccgcgagatttttttcgtcatgcagcagctctttgccgagacggtcatcttcttgttgattttctccgcgcttaattgaacctgccagacaggtggacataacgtctttgcctgattttttgatcagccgttccggtgaagcgccgacaaagcatttatctccctgctcaatcgcaaaaacatagcttgtcgtttggtccgtcaaaagcttgcggacaacgctctccgccggaataggcccatcatatgacaaaacgacttcccttgccagcacgactttatcatattgatttgccttcatatcatttgttgctgttttaatggcttcaagccagttttccacatcaagttcttccgcttttgttaaaacaggatattcttcatactcaattgaagaaactgcaaaagcttctgaaaaagatttcagacgtttcagcgtatcttctgcctgattaccgtctgccgcccattgattgacggttaaataatcgccgtctgccgtctttgtcagcatgagtgaggggataaagaacattccttcttcaaacccgttccattcgtctcctctctcttcagcgggattaaatgaaaaaccgccgaataagacagggccgaccgcggtatgcgccgcctcttcttcttcatgaatatgaaaagccgtctttttaaagcgctcccattgttcaaaaacgtcgtgataacgttttccatttttttcattcgattggaacagcgcttctgtgccaagaccgactattgttaattcactaccgggttctgaccaaaaaaatcgtttgcctttatatttttttgctccgtctttgaaaaatgatagagggtctaaagacgcaatacgtcttgaatagctcaataagacagcatggttgacttgtttggctttatgtaatgcatgatctgcttcctctcggaacgtatgctgcaccgttgtcaccatgagacattcctccataatccgttaaatgcttttaatacaatacacctgtgatgaatttgtgtcaaacacacagatttgagcacgacaaaatgcctgcatttcttattataaacctttttgcgcaaatgaataaagaaacaaacttgaattttctttccccactctcggcaatcactgtatccttttacttcctcgtgggaaaatgactatttttatccaccatttttctgcgtaaaaacgttcatactaacagtaagcatcacatagaaacgagggattgatgtgcttacaaacgaacagatcacacacttaaaaaaagaattggaagaagccagagatgatattttaagccgctttaaagaaaatgatcaatttcagttaactgatgaattcccgtatcaatcatccggcgaattgtcttcctatgacaatcatcccggcgatcaggcgaccgaattatacgagcgggaaaaagacctggctctgctcgaccatgaaagggagcaccttcgcgatattgattactctctgaaacaaattgaaaacggcacatacggcacatgtgaagtcagcggcaaggacattccttatgacagacttgaagctctgccgacggctacgacattggcggaatattcctcgcaggatgccgtttccaaagacaggccgattgaagaggaaacaccgttcggacagtttgaatttgatgatgatgaatcaatccgggcggcttacgatagtgaagatgcttatcaggatgttgagggatacggaaactcagaaacgcctcaggatttagaagatccgccgctcagctatggggatatgacaatgaactcagaagaaaacatcggctatgctgaggattatgaaaactttatcgcgacagatattaccggaaaaaacatttccgtgtatccaagcaaggcacacgaaaaatatgagcaggaactggacgaagaaggaattatgacgacctttggcgaccttcatgctgattaaaaccccggcaggccggggtttttgaatacaaataattggtttgctgcattttcacaccgaaaactcatacacttaatggtgcatgaaccttttgaacggtttaatctttccaagaaagggaactaacgtattgacattgaatgacggagggaacaaatgaaaaagaagtatatcggtgcgattattgtatttatcattacatatgtcttgttttctttagcagggtttctctttcccatcgaccgggaatggtacgacgcgctgcaaaaacctgactggacgctgggcggatcagtgatcggcatcatatgggcggttttgtttgcgcttatttcgctctcagcagccttaatatatgcaaagttttcatgtaaagaatccaaagctttttgggtgatgcttctcatcaattatatcgtgaatcaaggattcagctattttcaattcacacagaaaaatttgcttgctgcatctatcgattgcctgcttgtggctgtgacaacactcattctgttgctcattgccggtaaatacagtaaagcttcagcctggcttctggttccttatttattatggagcgcttttgccacatacctgtcttttaccatttacgctatgaacgcataataaaaaaccttgcatactatgcaaggtttttttaatgacccgtacgggattcgaacccgtgttaccgccgtgaaagggcggtgtcttaaccgcttgaccaacgggccttatggcggagaaggagggatttgaaccctcgcgccgcttacacgacctacacccttagcaggggcgcctcttcagccacttgagtacttctccgtatggctccacaggcaggattcgaacctgcgaccgatcggttaacagccgatagctctaccactgagctactgtggaaaaatcatcatggtgggcctgagtggactcgaaccaccgacctcacgcttatcaggcgtgcgctctaaccagctgagctacaggcccatgacaatataaaaatggagcgggtgatgggaatcgaacccacgacatcagcttggaaggctgaggttttaccactaaactacacccgcatgttgtttggggcgattgatgggaatcgaacccacgagtgccagagccacaatctggtgcgttaaccacttcgccacaaccgccaaaacaatattaaattaaatggtggctcgggacggaatcgaaccgccgacacacggattttcagtccgttgctctaccaactgagctaccgagcctttttataaatggcggtccggacgggactcgaacccgcgacctcctgcgtgacaggcaggcattctaaccaactgaactaccggaccattttttggttgcgggggcaggatttgaacctgcgaccttcgggttatgagcccgacgagctaccgaactgctccaccccgcgatgataattaaattagatatggcggaggaagagggattcgaacccccgcgggctttgacacccctgtcggttttcaagaccgatcccttcagccagacttgggtattcctccgtataagtggtggaccttgtaggactcgaacctacgaccggacggttatgagccgtctgctctaaccaactgagctaaaggtccaatggtagcggcggaggggatcgaacccccgacctcacgggtatgaaccgtacgctctagccagctgagctacaccgccaaaaacaattaaaatcaagtggagcctagcgggatcgaaccgctgacctcctgcgtgcaaagcaggcgctctcccagctgagctaaggccccaaagtggtcgggaagacaggattcgaacctgcgaccccatggtcccaaaccatgtgctctaccaagctgagctacttcccgtttttcaaaagtatgtatggcgcgcccgagaggagtcgaacccctaaccttttgatccgtagtcaaacgctctatccaattgagctacgggcgcaacaataagtgccgagggccggacttgaaccggcacggtagtcacctaccgcaggattttaagtcctgtgtgtctgccaattccaccaccccggcatggatggtatagtatagttggagcggaagacgggattcgaacccgcgacccccaccttggcaaggtgatgttctaccactgaactacttccgcgtttggcaatgcggatgaagggacttgaacccccacgtctgtaaagacactagagcctgattctagcgcgtctgccaattccgccacatccgcaagaaaaacatggtgagccatgaaggactcgaaccttcgaccctctgattaaaagtcagatgctctaccaactgagctaatggctcttattacaagagacttatatagtataacatataaaagtggtgccggcaagaggacttgaacccccaacctactgattacaagtcagttgctctaccaattgagctacaccggcctaatacgccaacttatgtatgattggaatggtggaggatgacgggctcgaaccgccgaccctctgcttgtaaggcagatgctctcccagctgagctaatcctccgtatattacacttacgtgtaatggcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaacgcataggacatgctaacacatgcgttgccacaggaagtggcgcatttagcaggtgttcctatgttttgaaggaatgatccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaatggaacacagactaagttcactgcatcctgcagtaacgtctgtgtgatctgcatcgtgcagaccttagtttgactgactacgcacatcactgtgcgatttatttaaaactttgaattaacaggtacgttttgtcttgtttagttttcaaagatcatgaccgcttattgaagcagctttattatcttaccacccagcttcttttatgtcaataactttttttaagttgtttccgaagcttttcgttgttgtctgctgttcatcagcgacgtttaataatataacacccttttgaaaatatgacaatagttttttaaaaaaaatcattaattattttctttcatacttatttcagtttctcttctatagaaagataagctgtcttgtggtttggtatattttcttgtatagtaagattgaactaaatacttgatgaccacaaggggagcattaaagctgagagtgaacgttttgttctgaccctttgaacctgttagttaacgctggcgtagggatgtggcaaagccaaatgatttgcagtttatgtaagcagcgcgcggaccttttcccatccttccccgcgctgcttttttgtttatccttgatacggttgtctgaccagggggaaaactatgaatcattcaacacagcttgtgcgcttaattgaaatagcgattatgaccggggcggctgtcattctggacattgtctcaggcatgtttctccggatgccccaagggggttcggtctctattatgatgattccgatttttttgatttcattccgctggggagtgaaggccgggcttacgacaggctttttaacagggattgtccagatcgccatcggcaatttgtttttgcagcacccggtgcagctatttcttgattatatcgcggcatttgcagttctcggtttcagcggcttgctcgcttccggtgtacgagcatcggcattgaataaaaaaagaggcgctttaacgatgtatgttataggcggtgttttcaccggcagtgtgctgcggtatgcggcgcatgtggtctccggagcagtctttttcggaagctatgctccgaagggtacgccggtctggatttattcatccgtctataacgcgacttacatgattccttcttttatcctttcggccattgtccttatcttattattcatgactgcgccgcggcttcttgaagctaagcggacgaactgaaacagcaggcggtttacgcctgctgtttttttattccgggctgtgccgttcgttagaatcactcagttcttttgtaagttcatttatgctttgttttatgtttcctttgcctgaaaaattctcaatcagctcttttacattgattccggaagatgcttttaagctttcctggagaccggccattaaattggttgcgtagcctgtgactttattggccccgccgttttcaccgcttcctcccgtatccacgacggtaattttatcaatgtttgaaagaggcgctgagacttgttttgcgtattcaggcagcattttcacaatcatatcaaggattgcagcctgcccgtatttttcgaatgcgtcggcgattttttctttagcttccgcttctgcgagacctttcaggcggatgacttccgcttcggtttctcctctcgccttttcagcctccgctttagcaagaccgtcaattctcacgcgttccgcttccgccttggccatcgcttcgatgctgtactgctcggcatcggcttcggcgagctgcttcgcttttgcggccgcggccgcttgttccaccgagtaacggtcagcatcggcttttttcttcacttcagagtcatattggcgctcacggcgcagaatttctttttcctccaattcaatctgcttttgccgctcaataattttaatttgcatttcctgctctgtcacctgctggcgcgcttttgcggtttcaagatcatatgcctggtcggcattggcttttgctgtatcctgctctcttctgtattccgccattttcagctgattgattttttccgcttcagctatttccgtcgcccgctccagctctgatttttttgcgtctttatcagcggccgcgcgtttaatcctcgtctctttatccgcttctgccgtggcaatgtccgcatcccgcttgacttgggcgattctcggcttgcctaatgattcaagatagccgtttttatcccggacgtctttaatcgtaaaagaaacgatcatcagccccattttagcaagatcctgagacgcgacccgctggacttcctgagaaaacttttccctgtttttataaatctcttcaacggtcatggagccgaggatggagcgcagatggccttccagcacctcccgcgcctcctgctcacggtcgtccttggatttccccaaaaattgttcagctgctgtggcgatttcaccgatggagcctccgattttaataatggcggttccgtcggccattaccggcaccccttgctctgtatagacttcaggtgtagagacatcaagtttgcttgacagtaaactgagaggttctgcctgctggaataccgggagcacgaacgttcccccgccccggacgattttcagacgatttccgccttcatcaatgtggacgttcttatttcccaaataacttccggtcacgataagggcttcgtccggccccgctgtccggtacttcgtaataaatacagcaataagtgcgatgagtaaaaagaatacgattccgataacaatgataatcggcatagtcataacagttcccccttagatatcagattggttcatgcggcgtcacaaaaagcactccgtctttcacgtcaatcactaatacggccgttccgtatctgatctgttcttgatcaaagctgacggctgatttagaaatggcgccccctattccctctatgatcacttccccatagccgtctttcgggacggaagtaatgaccctgccgaccctgccctttaaatctgtctcccgatatgcgagcgattcttccgctgatgaaagcggggcaaggacgaagaagtgaagcaggctgaccaaaagaaccgaaagaacaaatgaaagcaacgcaatgacaggacttgatagcggagcggcgatttcgccgatataacctgaggctgaaaagattgttaaaaaagacagaatcaatgcagggtttaaaaatgaaacaggaatggcttctgagaggccgtgaaacacatcttgaaaaaacagaatcaaaagcgtgagacttcccgaaataatcaatgtgtaaagatagaccgtttcaaacggcagatgaaatatgtccacattctatcctcctttcggctgaggtgtcggagtgttactttatatacggatgtaaaggtaaatggtttcaattttctgataaggaaggctgattacatgattatccaatccggatatgatatgtttactctaaaggaggagataggatgagcatttttaatgaagccagacagcagacctgggaagtactgaaagggctctctgatgaggaattcaaccgaaagcccgcggctgatgagtggagcgtgcgggaagtccttgaccatttaaagaaaattgacgaaacagcgcagacccttttatcaaagcaggcaaaagacgcaccgtttaaaaaaatcgaagacaaaccgatggagtttatagaggacagatcaaataaacggccggcgccgtcacacctcgaacctgagcaaaaccgaatctcagtcattgaagcaaaacaagaattagatacggcaagacagcagctgaccgcagttatttcatcattaaacgaggaagattttgaacgtgtgcttccgcatcccgtttttcaagaactgacgatccggcagtggattgattttatcggccatcatgaaaagcgtcacatcgatcaaatagaagaaatcaaacaaaaaatcgagaaggtctgagtcagaccttctcgatttttttcttggcgcgtttcggttcataggaatggatggtgaccgcatcgcccgtgcatatatcacccgggcgttcaacaatacagacaattcctcttctgcccatcgcgtgcctcacaaacgccgcggcgagttttggctgagccggataaaaggattgaatgacttctcccggctgaatgcacggatcattttctccctcgcacaacagagacgcaccgcttggaaaaatcattctgcttccttctttaagcggcgtcagcgcagaaaaaccgctgattgcgatgttagcgccgagccattcgggaaagatatgagaaatccccatcttctccgcaatgtcatcacattcctccatggacacgattgaaatttgtctccggttaaaaatttctgttcctctttcatacatcggctcacgcgcgccggccttttttgtcagtccgaaatgcaggtcaccgggaaacccgccgtattccgcgcgaagcttgtccatctttttggtaacaaattgttcggtatccgctatatatacgccttccgtctttgctgttatgcgtttccacatcagccaccaccgcctttttcttgacattatccttaaaaaaccccgctctgtaaaggagcggggttcatttattataccgttttcggcgttaagtcaaagcagcgtttgtaaatccagttgtatgctttctcattcaaatctcttggatttccgaaagtctgcggatctttcatggcttcttttgataaacgttcaatcatgtccggagacacaccttgttcttctaaactcggcacttctaaatcttttacaagatcatacatccagttgacggacgctttggccgcttcttcggttgtcatgttgcttgtatcgattccgaatgctttggcgatgcgggcgaatttttccggatagcctttccagttgtattccattaccggtcccatcatagctgcgacgcattgtccgtgagcgacagggatgatgccgccgagcgtctggctcatcgcatgcgccgcgcctgctgattcactgccgtatgaaaggccggcaagcatcgccgcctgcgccatgccgtatcttgcttccaaatcctctccgtccgcaaacgcgcgcttaatataatgcgccgcatattcaatggccattaaagcgacggcatcagtgatcggctgcgcgaatttcatcgtatagcactcgatggcgtgcgcaagtgcgtcaatacctgtcatggccgtcacatgcggaggcatggacgtgtgcagctcagggtcaatgaccgttaaatgcgcagcgataagcggtccgcccgtattgaatttaaattctctttcctcatctgtaatgaccgcccattgtgtgacctctgaacctgttcccgcagtcgtcgggatcgttgtcagcggaggaatgcggttttccagcggctttttgccttccgcggcttcataatcaagcacgcttccttcgtgtgtcgcttctaccccgatcgctttcgccgtatccatggagcttccgccgccgacagccacaagaccgttgcagttttcttttttatacagttctgatccttcgtttacaagacgtacaggcgggttcggctccactttgttaaacaggacgacttcgatgcccgcttcctgcaaagattcaatgaccgggtttgccactcccgcgttataaattcccgggtctgttacgagcagcgcttttgtgacgccaagcgctctgacttcacttcccgcgtgctgaatcgcgccgattccgtgtttaatgactgtcgggatttcgaatgtatggaatttatgcatgctttctactttcatatttaatgtcatattgtatctcctcctaattatgcttgaaaccagttcacagccgcaggtttcgtattgcggtaaatatgtttgatttccgtgtattcttccaggccgattttgccgagttcacggccgaagcccgattgtttgtacccgccccatggcgcttgcgcgaaatacgggtggaaatcattgatccataccgttcccatccgcagtttggcggctacgcgttcgcatttttcaatatcctttgaccataccgctccggccagcccgtaaatggtatcgttggcaagtctgatcacttcttcttctgaagagaatgactcgactgttaaaacggggccgaagatttcctcttggactattcgcatatcagacttgcagtttgagaaaatagtaggttcatagaagaaaccgttttgaagggcgggatcatcaggacgtttgccgcctgtttccagttttgccccttcttcgataccgatttctacgtatttttcgactttggcccgatgctcggcggaaatcagcggaccgctttccgtatcttcatgaaaaccgtttcctaatttgatgcgtttcgtgcgcttgatcagctcggctaaaaattcatcatgaatggcttcgtccaccaaaagacgtgacccggccgaacaaacttgaccggcatggaaaaacacggcgttcagcgcttgatctgcagctgtttcgagatctgcatcttgaaatacgatattcggatttttgccgccaagctccagggcaatctttttcacgttgccgcttgccgcctgcatgatttttttgcctgtttcaattccgcccgtaaaagagaccaaatcgacgtcgaggtttctcgccagctcatcgccgacagaggcgcccggccccagcacgagattggcggcccctttcggaataccggcttcttctattaattgaaagactttaatggttgtaagcggagtaatctcgctcggctttaaaacgatcgtgtttccagccgcaagagcgggagcgattttccagctcgcctgaaggagcggatagttccacggcgtaatttgtccgcatacgccaattggctctctgacgattttacttactgaatcgggaatcggagatgaaatgacttcgcctccgtctttatccgccaaaccggcataatattgaaatacatttgcgatatcatccatatcggctttactttcttcaatcgtttttcctgtatcaagcgattccagctcagctaattcgttcagatcgcgtctgattaattccgcaattttcagaacaaattgtccgcgctcgagcccggaaagcaccggccattccccttcatcaaatgcttttctggctgcggcgatggctttcaccgcatcatcccggtctccttcgcataccgttgcaatttcttcttgattaaatggattaatgatacggcgggtctgttttttttctgcactgatccattcgccgccgatataaagcgttttgctcataagagtcctccttaccgagaagtaagtttgttaaataaaaatttaatgtttttaacaatgttaatttaacacatgtttttttgcctgtcaaaacccggtcagtccgtttagattttgacattttgtcatgattcgttaagattaagaacataaagaaatgacttaacaaatttaaacttcaagaggaaaagagggacagtatggatgagaatccagaattcgcagctatagaacaagccagggatcttgtcattgattccattgcagagacgatggatctttacggaatcacccggagtgtcgggattttatacggaacaatgtatatgagggatgaaatgacgcttgacgaaatgcgtgaggaactgcagatgagcaaaccgagtatgagcacgggcgttaaaaagctgcaggatttaaatgtggtcaaaaaaacctttcaccgcggcacacggaagcatacgtttgtagcggaaaaggatttctttacgtttttcacgaatttctttccgccgaaatgggaccgtgaagttcaggtgaatttgtccgccatcgtacaggctcaggcggatttgcagtccgttttgctggccgaggaaggcagcgcggaattacaggaagaagcgcggcagttatatgatcagcttgaaagctcgaaagcttattatcattggctgaagcggctcgccgactcggttcagagcggggagatttttaaatttattccgatagaaacggacgaaaaaaacgcctgattttgattcaggcgttttttgtcgtgatttgattatttttgagaaaatataggaacataaccccatttacttccattaaaattgatggtaaatttttataggtatggtcgttcttttttaagaacaatcagcaaattttttttagggggatttataaaaatgaaacacaagtttttctcaactgtcatggcaagtttattcggcctggttttgcttctttctctgccgacagcgtcattcgccgctgagtcaggctcaaccgttcacgagccggaaatgtccacgaaagcgactgctaccttatttgcaaaatatacaggtgccagccagcaggaatggtcattttctgatatcgaattgacgtaccgtccgaacacgatcctgagcttaggcgttatggaatttacccttcctagcggatttgcggctacaacaaaagatacagtcaacggacacgctttgcgcgaaagacagattctgaataacggcaaaacagtcagacttccgttaaacattgatttgctcggcgcagcggaatttaagctttctcttaataataaaacattgcctgctgcaggtacatataagttccgtgcagaaaataaatcattaagcatcggctctaaattctatgctgaggacacaattgttgttcaaaaacgcagcacaccgccgacacagccatgcaactgcaaataattgcgaaaaacggaccggcacaagctcatcgcttgtcagccggtctttttttgtgctgttttctttcttccggccctcgcattgacaaacccctgaaacaggagtacattcttgtttgttgtatttggagtgacgaaaacagtttcttaaggagttatgaggattgggaaaaatcaaaaataaacaatttgccgtcatcggactcggccgtttcggcggaagcatctgtaaagagctttttaaaatggggcatgaggtgcttgcgatcgatatcagcgaagagcgggtcaacgcatactcctcttatgccacgcatgccgtgcgggcaaattcaacggaagaaagcgagcttcagtcgctcggcatcagaaattttgaatatgtcatcgtagcaatcggagccaatatacaggcaagcacgctgacgacgctgttattgaaggagctgaacatccctaatatttgggtgaaagcgcaaaactattatcatcacaaagtgcttgaaaagatcggtgctgatcgtattatccatcctgaaaaggatatgggcgtgcggattgcgcaaagcctttcagatgaaaacgtcttaaattacatcgatttgtcagatgaatacagcattgtggagctttcagccactaaaaagctgcatttaaaatcccttcttgatctcggcgcacgcgccagattcggctgcaccattctcgccgtgaaacataatggagacattcagctgtccccttctccggagactgtcattcatgaatgtgactgccttgtgctgatggggcataaacgtgatattaaaaggtttgaaactgaaggaatgtaaaaaaagccggcaagctgccggctttttttgatgcttatgtttcttcacttaactggacggcggtttggtcaacccagccgaccagcttatctttcacttgaatttggtaccagacggattctccgttttgtttttcagatacgactttaatatgctggccggtaaacttttgcgccgatgccagtttaatagaatgccgctctttcgacggcttggaccacacgtcttcaatggcgtggtctttgatggcgcctttcttatcaactgctttaagagaggcattgattttgtcatattcattcaggttataggtttctatgacatctttaattttttcagcatagccggggtctgtggcgtagccggatttttgaagggcagccgccgctgttttataattgtccgcttcaatgacgggcttgtacttctttttattccaagacgttccgttgacaaataatttggcatggtcatccattgattcaaaaaacgtgctgtatttacggaattttgcccgaatcgtttttcgttttcctttttcaaattcatccgttttcatcgtgacgtgttttcctttataatcaccttttacaccgaacaggttgcgcgctttccccgcaagctcactgttcccccagtccgattcgagaatggcctgtgcgagggtgatgctcggaaggacatgatatttctcatataaaatttgagcatgcccggaaaggctgtcaataaagacctgctgctcgtccacctcttcaggcggtttttcttccgtcactatgaatttcgaaaataccattgataccagaaataatccgaatataagagatacagcaaaaaggcacccaagcacccttttggtctttgctttctttttcatatcaaccttcctttaattccggaatcactagatttataattttactggtcattgatgaaaatttcaataaaatagggaaaaagacggagaaagaacacatcgtgcaaataaaaaagactcctcaatgaggagtctttttttgttatgccatgctcagctgagggccgaacaattcaaattgaacggaatcagagtcaaacccgagtgcaagaatcatatctttcatttgcgtcataaactgtgctgatccgcacaagtaacattcagcatcttgattcagatgaagctgctccaagaaggtttgatcaatccggccgctgtaaaaaggcttgtctcctgagcggtcttgttctgccggttcactgtatacataaatgacgttaatattcggatgattctccgcagcttgttcagcctctttgcggaacgcggcgtactctccgtttttcgcggcatgaataaaagtaacggaacgctcgggctgtttttcggcggctgttttcagcatgctcatcatcggcgtgattccggaaccggcactgataagaacaaccggtttttcggaagaagacagcttgaaatccccggcgggtgcactgacttcaagtttatctccctcttgaacttcattgtggagatgagaagaaaccgctccgtcctttttcacagatatccgatatgcgccttttcgagaagcatcagacaggctgtactggcgaatgtgcgtataaggagaatccgcaatcctcactttaatgctgatatattgtcccgcttcaaatccaggaagcgaagagccgtcactcggtttgatataaaatgatgtgatatctttgctttcttttgttttctgtataaccgtaaattctttatacccctgccatccggcttcactgtacatgtctttttcaatgccgataaaagcctccgcaataacaccgtaagctttttcccatgcctgcataatttcaggagttgcggcatcctgcagcacatccttaatcgccagaagcagatactttccgacaatcggataatgttccggttttacaccgatacttgtgtgtttatggccgatctgtctgaccgccggaatgatttgttctaattgatcaatattcgccgcagccgcaataactgcatttgccaatgctgcgcgctgagtctgtttcttttggttcgtttggttaaacatatttaacagttcgggatgatcttgaaacatcaggttataaaagcgtccggtgatgttttctccatgtgtttttaatacgggtactgtgcttttgatgatgtctactgttctctcatccagcatgttcatcctcaacccttctaaagatgtatttttaatatatctttatagtaagagatatttcgaataaaagatatatctaaaatgaatctttaaaaaagtcgtcacaatattgtgttgaatttggaatttatggattttacctccttttttatcacccggtgaaacagggacacatatatttgggaatatacgtttaaagatgaaagcgggggattgcatggtttccgatatcgattacacgtctccgaatacacagttcacttatgatgtaaatgagagccgtttttttacgaaagatgctcggaactttatcaatgtattggggattaaacagttaaacacgcttgaaaatatttcattattagatatctttctgagtaaaacaaatgtgattgaaccgcatacccatcaaaacgccgctgaattggtgtactgtatttcgggttccgcggtggtgtcgatgctgaatccgttcacccagaaaatacggaattatccgatctctccaggacaagtggcgaatgttccgcaggggtggtggcattatgaagtcgccacttcagacaaaacccaccttttggccatatttgacgccccttcgcctgaagtgatatatggctcggatattctccgtctgacgccgcctgagatcatggcgcatacgtactgtctgaatgagcacgagtgggaaaaagccgtttcaccgatccggcaatcaactgtgataggtcccgataaatactgcggacagtctgaaaacacgggtattcatgatatgaataagccttatcagccaaatacgcattatccgaatgatccgtatcggcattatgttcagccgttctatagggggtattaagcggatccacatcgacagaaagagcccctcattgcagaggggctcttgatcattacgatccggttccgcagcttactttgtactcgccttcggacgatttttttgaataacatacgtgcggcgtctgtccggtttcatctttccaattgaaccaatttacataataaaggttcccgtcctctccgcctccttcttctttttgaagaatcgcaaagtagctttgatacggatatccttttttataaatgtcatgcctgatggctcctttttctgaagcagacgtgaagatgacaggagaaagagccgggagcgccgttaaaagaagtgccagtgcagctgacagagataatataagatagattttctttttcattttctctctttcctttattttgagttgttagaaatgaagcggaacacagaggctgctgcagaggatgaaaaaacaaaaaaacccttatttatagaataagggtttaaaggtatggagccaagggggctcgaacccctgacctctacgctgccagcgtagcgctctcccagctgagctatggccccgtgctgtaacgtcatgttttattatagacgactcttctatgaatttcaagcagaaaattcagtttgctcatattttcctgagacgtttttcgaacataaaaagaagaccctccgggggcctcttcgtttatcgcacgagcatgattaaaatgatgccgaggatgacacggtaaatggcgaacgggacaagcttaatccggttaatgagccgaagaaaaaacttgacgactaagagggcgacgacaaaggcgcagataaagccgacaagaaaaaacggaatcatgtcataagaaagactgctccagtatttcaccagcttcagaaggcttgcgcccgccataatcggaatcgccataataaatgtgaagtctgcggctgcccggtgattcaagcccacaataacacctccggcaatcgttgagcctgatcgggaaaatccgggccataaggcgagacactggaataatccgacacagaaagcctgtttgtaggtgattctgtccaccgtatcgatcgtttctttccttttattgatccagtccgctataagcataagcacggctccggcaattaatccgtaagcgaccgttctgacggagaataaatagcggtcaatgaaatcctcaaataaaaagccgagcaccgccgctggaacaagaccgacggcgatttgcgcgatggtcagcctgtatcccttctgctgatcgcgcgtgacgttttttttgaggccgagtaaatgtaatatccgatccttaaacacaatggccaccgccagaatcgaaccgagctgaatcaccactttgaaggaattggcggcttccggattcatcaggcttccggatttcagccagatgtcatccgctatgatcatatgtcccgtggaagaaaccggcgcgtactccgtcagcccttccacgattcccaaaacggctgctgtgaacatctcccatagtgtcatcccattcttcccttcattcatcatttacaaaagagaagctctcctttgaaggaaagcctgtcttataataaatatcatgtccgttccgattttatgacttcgatacagcatcatttttttcttcttcatataaatgcgaacgcattttgaaccaatcaaacagatgggtcgtgaccactttgatgaccgcataccccgggatggctaaaataatgccgacaaccccgaacagctttccggcggttaaaagaacaaagatgatggtaatcgggtgaatgtgaagatttttccccatgatctgcggcgaaattaatttcccttccacgagctggacaacggtccagacaatcgcaagcttcagcagcataaagggcgaagtgaccaacgcgataataatcgccggcgtgatagcaatggtcggccctaaatacggaacaacgctcgtacaagcggcaatgaccgcaagcagtgacgcataatcaagtccgataatcagatagccgataaataataaaaacccgatgcagaagctgacgatgacctgtcctctgatataggagcttaatctgtggttcatttcactcagcatcgtatacgtttgttctttcagacgggtgggcacaaactttaagatatagatcggcagttttttgccgtctttcagcaaatagaacagaataaacggcacggtcacaattgaaataatcacttcagtcagcgcgccgataaaattcccgactccggtaaatgtgctgtttgcaattgtcgccgcctgcgccgatactttattggcaagatccgaaatgttgatattcatcgtcttttgcgcctgatttacaaaatcgcttccgatcaggcttttcgtctgatcttcaacgatgtccacatatttcggcaggttgtcgatcaggctcatgatctgttcctttaaaaacggaataattgaaacgaccgtaatcgaaatcagccctataataatgaggtaaaggagcaggatggaatagactcttttcactcttattttttccaatatatctacgatcggattaagcagataataaacaattcctgtcaaaatgacggggagcgcaatcgttttgagcaggacgataatgggtgtgaaaataaatgatgtcttcataaagacaaggatattgagaccgatgagcagcaatacaagcaaaaacaagacaaatttattgtctaagaaaaactgtttaaatctgccgccccatgtttgcaatgtttccactattgttcctccatcatatgtattttacttaaattgtacactatcgttcctgtaatgaaaaataataaccggtctctatgggaatttttcctatccgtttagctggcagccttttttccatttatgtttctttgaaaaaaagctataatgtaagccaatacatagaaggagcgatagcaatgattcgatttgcaacagtcggaacgaattggattacagaacgatttctggaggcggcttctgctattgatgattttcaattaacggcggtttattccagaactgaggaacgtgcggcggaattcgccggcaaacacggcgctgctcattatttcaccagcctgaaagaaatggcggaaagcaaagcctatgacgcggtgtatctcgccagcccgaatgcatttcacaaagagcaggcggtcctttttatggaacacggcaagcatgtactatgcgaaaaaccgtttgcgtctaacgcaagggaaacggatgaaatgattcacgcagccaaaacgaacggcgttctcttgatggaagccatgaaaacgacgttcctgccgaacttcagcatgcttcaaaaccacttacataaaatcggacccgtcaggagattcacggcaagctactgccaatattcatcacgatatgatgcatataaaaacggtacggtgcttaacgcgtttaagcctgaattatcgaacggttcgttaatggacatcggcgtgtactgcatttatccggccgtcgtcctgttcggcaaaccgaaaaacgtcattgcgaccggtcataaactagcatccggcgttgacggcgaaggcacggtcattctgtcatacgacggatttgaagcggtgctgatgcattcgaaaatctcaaattcgtttgccccggcggaaattcagggtgaagaaggcacgatcgttctggacagcattcacggaccggaacgggcggaaatccgctatcgtgacggccggacggaagacatttcagtccctgatctgaaaccttcgatgtactacgaaacggctgaattcatcaatcttcttcgaaacggacagcgggagtcttccgaaaatacatttgaacgttctttcattacggcaaacattatggaagaagcgagaaaacaaatcggaatcgtctttcccgccgatcaaaactaaaaacatccgcccggattcgggcggatgttttttatttggacgctaacaggtcagcaaacgcttttgcatactgcggaaggtcgggcgggcggcggcttgatacaatgtggccgtcagttacgacagcttcatccagccactttgcccctgcatttgtcatgtcgtctttgatgccgggcgtgctcgttactttttttcctgcgagaattccggcagatataagcacccagcccgcatggcagatctggccgatcggctttttctgctcgttcatcgtacggatgatgtccaaaacttcgggatatcttcgcagtttgtcaggagcccagccgccaggcacgagcacggcatcatactcctgaataatcaggctcttaaaatcgtaatccgccgtcgcgggcacgccgtattttcctttgtatgaacggcccgcttcttctcctattaaatgaacgatcgcgccttcctctctcagccgatagacgggataccaaagctctaagtcttcaaaatcgtcactgacaagcgctataacttttttgccttctaatctcatcactgccactcccttcttttatattagtgtatcgcttttttcagatgaggaaaagaaacagctcgttacagctgttcttcgtcttcagactgaatcgtaaatttccgtgtgacctgttgcagttcttcagccatatgcgcaagcgtttcggcggatgaactgatttcttccatggaggccagctgctcttcagctgaggcggcgatgtcttgaatgccggcggacccttctttggcgactgaggtaatgtcctccaccgcgtttgtcacattttgcgacccggctgcaagctgctcaagcgttccgttcatatgctgcaaggcgcctgaaatctgagtcgtcatctctgagatttttttgaagctttcggccgtttgatccgtaatatcgaggccttccttcacatcttgattcaccgcttggaatacggaaagcgatgtggcgatttctttgacgatttcctgaatcagcgtttcgatttcctttgcggagccggctgattgtacggcaagcttcctcacttcttccgcaacgacggagaagccccgcccgtattcgcctgctcttgccgcttcaatggccgcgtttaaggcaagcagatttgtttgatcggcaatgccgttaataacgttcagaatgctcttaatgtcgtgcgacttcgtttccagcccttttacgacggcttccgcctgctgtacggaacgatcaattgttttcatctggccgaccgttttcgccactaattcttctccgcttccggccgtttcagaggtttggatggcggattcagtgatttccgccgatacattcgccgtctcggcaatgcccgcattcatttgggaaaggtgatcagcactttcttccaatttctcgctttgtgattcgtttccgtttgagaattgttcaatcgccagagtaatatgctctgtcgccttgcttgtctgtccggcggatgccgtcagctcttcggatgaagaagcgacatgttcgacggatgattggatgacgccgatgacagaccggagtgatgccgacatctcattgaagctttggctgagctgcccgaattcattttttgacttgatgtcaatgacttccgttaaatcgccgtcactgattttatctgatgtcgagacaagttttttgagcggttttgcaatcgagcgaatgataaagaagattaaaataccgccgacgataagagaaaccgccaggatgatcagcgccattttcatgacaggcgaggctgcgtcatggatctcactgacaaaaaatgtgccggcgattttccagcccgtcagtttgtttgtcgtgaaagccattttcttctgctgtccttcaaacatgtattcaaacgatccgcttgatttggaaaatacttctttcgtccactctccggagccttccgttcccgcttttatagtcggatgggcgatgtattttttatcccccgttgtaatgaaggcaaatcctttatgaccgatctggacgcgttcggaagcgttcagcaggtcgcccagattaatatcaagcgccacaacgcctgatccgtcttttgtctgctgggcaatcgtaacgaccgtctgtccggttgcagcgtctttataaggctcggtaaacaccggctgtccgcttttttcaaccgcctttgtataccactcgcgcgtgagcggattataatcggacggcatgtcagcggacggatatttcacaaacgctttgtcgcgagacgcggcgtaaattgacgcgacatcgccatttacggtgacatactgcttcatattgtcgagcagtaccgatttatttttcgtgttcagtttttcctttgtgattgattcgctgtagtagtcaatcgctttcagcttaccctcaagcatgttttccagcacgctgttcagttcactgacatttccctgggcgctgtgggtcagttcgctttctaatgtactccccgccgtttggtagctgaagtaggcgagtatgccgaccggaagcaccaatacggctaaaaatgccgcgatcagcggcttgctgatggatggctgtttgatccaatgtatcagttgtttcattttttcagtctccttctttgaaaagctaaatctaatatcgtcagataggacaaaagatttattaaaaaaactaaaaaaaacacccaaacagcacatttgggtgttctatgatctattaatctattttaaatcgtttcgtcatatcacgtaattcttccgccatttgggataacgtttccgaagacgaactgatttcttccattgaagccagctgttcttcggcagaggccgcgatatcctgaatgctggcggagctttcttttgcgatggacgcgatttgctcagaagctcctgaaatctgctgtgatcctgctgtcagctgttctaccgtcgcattcatattttgaatttctccggcgatctggttcgtcatttcagaaatccgtttgaagctcgtttcggtctgattcgtaatatccagtccgctctccacctctttgttgacggattggaacatgccgagagatgtattgatttcgttgacgatttctataattaagctttcgatttctttcgctgaatcggcagactggaccgcaagttttctgacctcttcggcgacgactgagaagccccggccgtattcacccgcacgcgcggcttcaattgccgcgttcagcgcaagaaggtttgtctgatcagcgattccgttaatgacaccgagaatgtttgtaatgtcttttgattttgtttcaagtccgcgcaccacttgttcagcttctttcactgaccggtcaatgacgttcatttggccgaccgtctggtggacgagctttccgcctgaattggcgacttccgctgatgtggcggaggattcggtaatgacggcagatgctttcgccatatctttaagcccgctgttcatttgataaatatgttccgccgcgctttcgatattttcactttggctttcatttccgttagaaaattgttcgatcgccagtgtgatatgttccgttgccttgcttgtctgctccgctgaagccgtcagctcttctgaggaagatgcgacgttattcacggaatcctgaatggcatggatgagagacctgagtgaagcggccatattgttaaagcttttgcccagctcgcctaattcatcttttgactgaatttcgatcgtttctgttaagtcgccttcactgatctgtttcgatgatgtcacaagctgcttgagcggttttgtgattgaacggataatcagcaccatgacgatggttccgatgacaatcgctaatacgagaacgagcagggacagatgaaggatcggcagggccgcttcatgaatttcgtccagatacatcgttccggtaatcttccagcctgtcagcccgttcgtatcataagccattttcttttcctggccgtcgtatttgtattgaaaatcaccttttttgctggtgaacaactgttcagcccactccccgtttaatactgtgcctgacgcacggttcgggtgggcgaccacttttttgtctttcgtcaggataaaagcgtagcctgattttccgatgttcactttctttgtcgttttcagaagctcatcgattttcatattgatggcgacgacccctgagccgtctttcgtctgctgaacgaccgtcacgaccatcgtattggtggaagccgtgcggtaaggatctgttacaacaactttccccttattttccacggcctttttataccagtctctttcaagcggattatatcctttaggcatctgcagatccggataccgtgtgaaatgtccttccgtgtcactcgtatagatggattccacgtctttattaatcttcatgtactctgtgaatttatcggtaatttgcgattggtttttcggcttgtaccgatcctttgtgagccagtcgctgaaatatgccgttccgtcttccttttggctgatgcttgtgttgatcatatcgttaatctgctgcacattatctaatgcgcttcccatcatctgcctgtcaagcgtacttaccgccgattgataggcgataaaagccagcgttgaaataggaagaatgagaatggccaaaaaagaaatgagcagttttcttgtaagcgatctctgcttgatgatttgcacaatttttttcatctgctatatctcctcttgcgtgtttacccttcatatcggcaattatgggtaaatatacacatccaaaaagaagaaatataacgaaacatactttttacctattgcaaaattagtcttttagacttaattaagagtttatcttaaaacgctttgtcagttcgcgtaattcttccgccattttttccagcgtgacggctgaggaactgatctcctccatggacgcaagctgctcttcagctgaagccgcgatgtcctgaatgccggccgcgctttgtctggagactgccgcgatatcctctgaagcgtttgatacttcctgagatccggcagaaagctgttccacggttgcattcatattttgcagttcaccggcaatctgacttgttttagcggaaatgtcccggaagcttttttccgtttcgtccgttaactgaagtccgcttttcacctcgtgattgacggattccagcattccgagcgaagtatgaatttctttgacgatttcatgaattaaggattcgatttctttcgctgaatcggcggattggacggcaagctttctcacttcttcggcaacaactgaaaaaccgcgtccgtattctcccgctcttgccgcttcaatggctgcatttaaagcaaggagattcgtttgatcggcaatgccgttaatgacgcgcaaaatgctggtgatgtcctgcgatttgagttcaagcccttgtacgacttgctccgctttacttacggattggtcaatggcgcccatctggccggctgttttcttgacaagccgctcaccggcgccggatatctccgccgattcaattgaagtttccgtcacaacggctgccgcttccgccagatcgctgagcccgtctttcatctcattcacttgtgctgtcgctttatcaatactctcactttggtcttccgttccattagaaaactgttcaatcgcaagggtgatatgttccgttgctttgctcgtctgctcagccgaagccgtcagctcctctgaggaagaagcgacatgttcaacagagtcctgaattccctgaataagcgaacggagtgaatctgtcatatgattaaaacttttaccgagcacgccgagctcatcttgagagctgacatcaatggtttcagtcagatctccgctgctgattttttccgctgaagctacgagacgttttaacggtttggtaattgagcggatgacaaaataaatgaaaatcatccctgcggcaacggctatcgccaatatgataacggccagagtcagaaccggtcttgccgcatccttgatttcatccacggacatggttccgctgatcttccagcccgtcgcttcattggtcacgtacgccatttttttcgctttcccgttcagcgtatattcatagtcgcctttttgcccgctgtataatgtatcaacccattttcccgataccgccgcgccggctttttcatcactgtaggcaacggcttttttatttttgctgaggataaaggcgtatccttcttttccgatgttcacttcttttgtcatcgtgatgagatcgtcgatttttatatcaatggcgacgacgcctgatccgtcttgcgccgcgcgggccatggtgacgaccatctttttgtttgagatggactcataagggtccgtgatgatggtttggcctttattctccatggcttcctgataccagcttctttcaagcggattgaaatcggccggcatatcggcatgcggataacgggtaaacgttccttccttgctgcttgaaaatatggcggacgctttatcattgctttcaataaactgtttaaacctttcttgcatttccgtttggtttttttctttaaatttagcgcttgtcgcccattcgctgaaatatgcagagctttttgtaaacattccgatccggtcatcaatcatattgtttaagatttgcacatttccttcggcgctttccatcatttgcttttcaacggatgaagccgccgaacggtaggcgccggcggccaatactgctaccggaataattaagatcagtaaaaatgaaatgataagttttttggctattgattttctggcgattttttttgctgtttttttcaattttgtaaacctctttcaatcatttactgtttatatcggccgactccctttttattacattgaaaattaagtcataaatgaaaaatagttctatgtactccctttgtatgcaagactttttatttaattatccggctgtcactataaaaaaggacgccttccacctggaaagcgtccttttttactagttgattttaaattgtttcgttaattcccgcagttcttcggccatttgcgccaaagtatcggcggatgtgctgatttcttccattgatgcaagctgttcttctgcggatgcggcaatatcctgaatgcttgctgcgctttcccgtgatacgtccgcaatatcggtcactgcggctgaaacgtgctgagagctgtctgacagctgttcaaccgtgccgttcattgattgcagtttttcggcgatgtcgttcgtcatgccgaagatattctggaagctttctttcgtgcgatccgttacggcaagtcctgattgcacttcttcattaacggatgtaaacatgtgaagcgaagtattaatttcagccgtgatttcctgaatgagtttttcaatctctttggcagaaccggcggattggacggcaagctttctcacttcttcggctactactgagaagccccgcccgtattcaccggctcttgccgcttcaatggctgcatttaatgcaagcaggtttgtctgatcggcaataccgttgatgactcttaaaatatgagtaatgtcttttgatttggcctcaaggccttttacaaccgcttccgcctgctggaccgattgattgatgagattcatctgcccgacggtttgctgcacatattcttccccggtgccggcagcttccttcgattgtttagatgcctccgtaatggatgatgatgtgcgggaaacggcggcgagtccgtcatttatatgattcagcttggctgagcttgaatcgactttttcgctttgctcttcgttcccgtttgaaaactgctcaatcgccattgtaatatgttccgtcgctttgcttgtctgagaagctgaagcggtcagctcttccgatgacgcggccacgttatcgacagagttttggatcgcgctgatcagtccgcgcaaagattctcccatttcattaaagctcgcgccgagttcgcccaattcatctttcgagcggatgtcaatggtttcagtcaagtctccgccgctgatttgtttagaagagcggacaagccgtttcagcggtgacgtaatggatctgacaatcaacagaattaaaattcccccgatgataatagatgctgcaaggacaatcatccccatcgtcagcaccggttgtgaggcatctttaatttcgttgagctccatgctcccctctattttccacccggtcagtttatttgtcgtaaacgccatttttttattttgatcatcgagcttgtatgaaataatgccgctgtctttgctgtatacctcattcagccacggcgttgaaactttatcgcccggtttgtggtctttatgcgcgacataggttttatttttggacgtgataaacacgaatcctttttgcccgattttgattccctgcatctgcttcagcagctggtcaatcgtaatatccatggccactacgcctgttccgtcctgcatctgctttgccacggtaatgaccatgctgccgtcgcttgccgcggtgtaagggtcggtgacaacgagcgtgccgccggccttcacagcgtctttataccaagtgcgtgttctcggatcgtaatcggccggagtattttccttcggcgcctgtgcgtagctgccgtcttccgttcctccgtaaatgcgggctacgtccttatgaatagacgtgtattgcccgaacttttcttcaagagcagacatgtttttctttgagaaggatgatccttttaacgtttcactgaaaaattcaatcgcctttgcttttgcgccgatatcatttgtaatcgttgtgttaaaagattcgatgttatttttcgcgttgcctgaaatctgatcatccagcgaattgctcgccgtatggtatgaactgaattctaacacgagaatcggtatgattaagatcacgataaatgaaatgattaatttccgtgaaatcgatgcctttgtgcaccaattaatgaattttttcatattaagctgctccctcaagtgtgataccttatatatcggctcagtcttcacattttgttaacatttcctccttttttatcacttgattttcattgcccaagcttcctgcatatcttataaaaaaagatagggggcgcgcagatgattatcatatccggccaagtgcttcggcctcaggacatcgcgaactggcagacggaagaaagccttgttccgtatataaatgaactgctcaattctcccgtacaattcgattacgggtcgattgctgaactgatgttcgaggtgcggctgcgccgccatattgtggaagccgcaagagaactgcacggatcaggtgtgaaatttgcaactttcgccaaaacatacggaaatacggcttattggagactgacgccggaaggagccctggagctgaagtacaggattcccgcttcaaaagcgattcgggatattattgaaaacggggcgttttacgcatttgaatgcgctaccgccattgttgtgatttattatctggccgtcttaaagacaatcggtgaagaacggtttaaccggcgtttccgggatatcactttgtatgactggcactatgagcatctgccgatctacacggaaaccggcagccactttttacggggagactgtttatattttaaaaatcctgattttaaccctgcaaaggctcagtggcggggagaaaatgtcattgtgatggggaatgatcaatatttcgcccacggtctcgggattctgaccgctgaacaaatcatccagagattgaattctttaagaaaaaaaaatgccgtgcagccggcttatctgcttaaccaggcaacaaggcttgatgcacccgcgctttatcagatcatgcattaaaacaatcccatcgtctgtcattgtgacgatgggatgtgaaatgcttttcttttccggtaaaaagccgtcgtgccgagcgcttggtttgcagcccattcaaacttctctaaatcatggcgggtgacggctctgtcccgtctgctccatttaatggcgcggacaaagtaataccctttaatcggcgccatggtgactttggaatgcggaaaatcttcaaagacaaactcaatagtccctctttttttataggacatttgaagaatcttcatcatccatcacctcacgatttctggattatgattcgcacaatctgtccaaaacggttttcacgtctgtcggcccctcaagtttcgcggcggactggccggcccataaagacatatgctccgcgtctcctgattgagccgcgtgcccgcgcatcggctttgtcagcgtattatgcagcggataaggcagcgtttttccctcgtcagcttcatatgttttcatgaactgattcacgattccccgcgcctgttttcctgaaaacagggtggtcagccgcgtatcggctccttttgattcggcaatggctttttgatatgccggtgaggcgctgctttcttcacaaaggagaaacggtgttcctacttgaacgccgtccgcacccaaacatcgggccgcctgcaccccgcggcggtcaaaaatgccgcctgccgcaatcaccgggatattcagcgtgtctttagcctgcggaatcagcgccataaggccgagagccggttctcctttaaccggcagaaacgacccgcgatgcccgccggcttctattccctgaaggataacggcgtccattccccgttcttcaaaagccttcgcttcctccggcgttgtcgccgtgccgaaaaggaaacaaccgcttttcttcagcttttccgccgttttttccggcggcaggccgaaggtgaatgaacacgctttgactccgtaacggatcagaagctccgctttttccgcgaaatcattccattcttctttcagatcagagaacggcttggcgtcttttgccctcggaatgcgggctttccatttttcaacaagttccgcctcaggcatctgtctttcttccgggacgaaaagatttacttgaaaggagcggtccgtcagctctttcatctcgataagctgtttttcaagcgcttgcgggctgacgtatcctgaagcgaggcttccgagcgccccttcatttgataccgccgaagccagacgcggcgtgaccagtccgccggccatcggggcctgaatgacgggctttgttaatgataacggactcatccactcactcatttgttttcctccgtttcagccagtattttgatataacatgttctgtttcgcggaccgtcaaattcgcaaaaataaacgccctgccatgttccgagtatcaggcgcccgtcttctatgatgacatgctgagaggcgccggttgtactcgctttcatatgtgccgccgtatttccctccatatgccggtccagttcgtgctcccacggatacatttcatcaaaccttctgagcatatccctcttcacatccgggtcggcattttcattgatggtaatgccggcggtggtatggggacagtatatgagcgccaaaccgtttcttacgcctgtttcgcggagaaacgattcggcttcatgtgtgatgtcgatcatttcatcccttttgtttgtttgaatctgcaattttttcagcatatgaatgcctcctttctttttctcttcctttcccatattcgtttctgtatttgtcttttcctgtcggatcgcgatgataaacacagatcacaaaaaacttcagcctcgggactgaagtttttcaccatatatatacgcgggcctcataaggctttaagaggaaggatgtcacatggcggtgcgattctgtttccacgtttgcaagcacgagagaatcggagtcaagcggataaccgggatgcctgtataaagcgggggttcgggacagattggtgatgatcagggcggtttttgttccgttttttcttagataggcataaatctgccggtcattcggaagcagcaattcatatgtgccgctgatcaatacgccgtgtttttttctgagggcgagcagccgtttgtagaaatggtatacggatgtttcatcctgcaattgtgatgcagcgttcagccatgtgtggttcggattcactccgagccacggagaagcatcagaaaacccgccgttcgcctcaccgctccattgcatcggtgtccgtgaattatcccggcccttcttccagatgatcttcatcacttgttcatgcggaacgccgcgggacgtctctttttcatacagatatttaattgcggcgtcatcataatcttcaatggatgggaacgaaacattggtcatgccgagctcctgtccctggtaaataaacggcgtgcctttcatcagcatatacatcacggcgagtgccttggcgctttctgtcaaaaaccgttcgtcaccccataccgaaacggaacggggctggtcgtgattttccataaataacgcattccagccctttccttcaaggctgtactgccagccggacaagacgcgcttaagcgccggaatggagatgctttgatcatcttccgtatcccagaggccgagatgttcaaattgaaaaatcatttgaaagacgccgttttcttcaccggcccaatcagccgcctcccaagccgccactccgttcgcctcgccgaccgtcatgatcggatagcgcgaaaatgtttcccgcttcagctcttttaagagatccattatgccttccccattcatatgatacgggaaagacgggacgtacgggagaccgtccgggttcggcatgtcagggagcccttcttttttcttaatgtgagaaatggcatccacccggaagccgtctatgcctttatcaagccaccagcgaaccatctcataaacggactgcctcatcgcttcgttttcccaatttaaatcaggctgttttttgtcaaacaggtgcaggtaatactggccggtctcttgatcatattcccacgccgatccgccgaaaatgctttcccaattattcggctctttgccgttttttccgtctctccagatgtaccagtcccgtttttcggaatctttcgctgagcgtgattcgataaaccaagggtgctcatcgcttgtatggttaatgacgaggtctataatcagcttcatgccgagcgcatggacatccgcaaggagccggtcaaaatccttcatcgtcccgaattcgccggcaatttgtttataattccgaatatcgtagccgttgtccgcgcccggcgagtcaaaaacgggacaaagccagatcacatccgcccccaactcttttatgtaatgaagctttgctctgatgccgttaatatcgccgattccgtccccgttcgaatccataaagcttcggggataaatttgatagacggccgccgttttccaccaatccgttttcataccgacactcctttctttacagcatatgaaggagcgggacgaagaagcattttttccataaaaaaagcctcattgcaaaagcaggaggctcagaaatcagtttttttaatctcaacgaagcggatatgatggtcttccgcttccagcaccttaaattcacacccttcggcatgaaacacatcaccatttttcagctccattttttgtgttaagagccagccggcaatcgtgtcaatgtcttcattttcgatggcgatatcaaggagatcattcacctcttctatgagcgccttgccgtccatcacataatggtgttcgccttttttgacgatgtggggcatttcatcctggtcatattcatcacggatttccccgacgatttcctccaatatgtcttcgacggtcacaagtcccgccgtgccgccgtattcgtcaacgagaatcgccatatgaatccgctccttctgcatgcggatcaaaagctcctgaacggggatgctttcaatgactctgatgaccggacgcatcatttcttttaattcaatggagcggccgagaaaatacgctttaaataaatccttattgttaataatgccgagaatgtgatctttgtcttccttaataaccggatatcgcgtataccgttcgttgatgatcaaatgtatggcttcatcaactgactgttcaagcgagatgacggcgatttcggtgcgcggcaccatgatttctctggcgacccggttatcgaattcaaatattttattgacgtaacggaattcagattgattgatttgaccttttttatagctttcggacaaaatcagccgcaattcttcttcactgaccacgacctcatgttctttcaccgaatgaaaaccgaacagcttgaccaaaaatccggctgagccgtttaacagcttaataaacggatacatcactttataaaacagaatgagcggtttcgccgtccacagactgacagcttcggctttttgaatggatatcgttttcggcgcaagctctccgatgacgacgtgcagatacgtgacggcgataaacgccgcaataaacgtgacgacgtgcgtaatagatgacggcattccgatcaggctgaaaacaggatgaagaagccgctgaatcgtcggttcaccgagccagccgagtccgagcgccgtaatcgtaatgccgagctggcacgctgataaatattcatcgagatttgaaatcaccctgtgcgccgcgagcgcccggctgtctccggtttcaaccagctccgcgatttttgaaccgcggattttgacaatcgcaaattccgcagcgacaaagatggccgttaatccgattaacagcataatgagaatcagttttaatataagcaaaaaaacccctaccgcaaacggtaaggggccacctccttcgtgttaattctcatcacgaccatttaagaaaatcatcacaaaacgaagcagctcgaataatgaaacgagcgccgcagccacatacgtcagcgcggcggcgttcagcactttattcacgccgtgttcttcactgttgcgaatgaatccttccgacacgataatccgcttcgccctcgcgctggcattaaactcgacaggcagtgtgacaagctggaaaaaaacagcggccgaaaacaaaataatgccgagtccgattaagttcaagctgcccaggagcatcccgcccaagaaaagcagaggggcgaccccggaggcaaaattgacgaccggaaaaattttgtgcctcagcacaagcgcgccgtatgattcctgatgctgcaaagcatgtccgacttcatgggaagcgacggaaatggcggaaatggagcggccgtaatataccggctcagataaacgcaccacccgctccgtcgggtcgtaatggtctgttaaagtgcctcttaccggttctaccggcacatcatataaaccgttaatatcaagaatccgtcttgccgtttccgcccccgtccgctgactggaggcttccacgtctgagtatttctgaaaattgcttttcactttaaattgtgcccaaaacgacaaacccaatgcagcaattgttaaaaagataaacagcatattatcctcttcctttttctcttatatcgtacgatctgcttatatattattttaatgattgcccgctttcctgtacagaaatccgcttcttttttctgacaggaatcaatcctccgagcatgatgaggatacacccggccattccgatgtaaaacggaaacgtgcctgcggtctcttttgcaaaaacaagccatgaaaatccgccggacatgtgattgtatccattcaaatcgaaaataagcaatacggccgccgaagcaagcagctgcgctccggccagcgccgccaacagtttttgaatgaccgtcatttgactcaccctttttcggtccgctttctttatcatatgaaaaaataagggtgaatatgttttcggcgatttttgaaagacatcaaacgaactgggacatactgtataaaaaaagatacaggtgtgatcgacatgaaagtgacaaatggcgagaaagaacagctgagcaatgcgatagacagaatgaacgaagggcttgacgccttcatccagctctataatgaatcagaaaacgacgaacctctcattcagtttgaagatgagacggccgatttaatcagacatgcgcgtgactcatacggccaggaacagctggacgaaaaactaaacaccattattaagcagattttatccatctctctgtcgaaagaagagccggacgaatgaaatcaaaccgtatttttatttcctggctgagatggccgttatatgttcggatcgggctgatcattatcgccttgattttattgttcggccaactcatttacatgctcgaaccgaagcaattcacgtctgtgtttgaaggggtttggtgggcggtcattacggtggccacagtcggctacggcgattacgttccgcagacgccgctcgggcagattgccggcatggtgcttgtattaagcggagcgagttttgtgaccgcctatttcgccacgctttcttcagccgtgttcagcaaacagcaccgctatgtcgaagggaaggtcgcctttaaaggcaaggggcacgtcattcttatcggatggaacgaaaaatcgcatatgctgctgaaagagctgcagcacatcgcaccgtcaaaaactgtcgtcctgattgatgattcattaagggaaggtccgcttattgaaaacgtccatttcatccgcggacatgccgctgatgacagcacgctcaataaggcgaatattacggaagctgataccgtcattctgacagcggaccagcagaaaaatgaatccgaagctgatatgctgtcggtattaacgcttctcgccatcaaagggctgcatccgtctgtttattgtatcgtagaaattttaacggaacggtatgtcaaaaacgccgagcgcgcaggagccaataagattctgtgcacatcacacctgtcgagccgggtgatgtttgagcattaccgggtcaagctgcagcttgccaaaccgcaaacgctgtcagatctgacgctggagaaaaaggtgcgcatcattcccgtccccgaggaactaaagggctcatcttatcatgactgcgcgctctattatctcagacggaataccacgatcatcggcatacaaaaagaagaggggccgatgctgacccctcccctgtcataccaggtgctcgatactgatctgtttttggctctttaatgcagcaggacgtcttccagctctttcacaagcgagatgccgatatctgtatatgagcggtcaattgccgcatcccgccgtttcggttcggagaattggttgaataatgactcaaaaacaccgccgcctgctgcatcatccgtttcctgctgataaacgtgcctcagcaaaaagggtgtgccgattgtaacggcggccccccgttcatccaggtgtcccttatttgcttcaacagggatacggagaaataaatagccgtcctgatcggaaattttgtaatcaaagaacccgcggtcatactcccagccgcctccgatggtataaccgatcggtttcatcacctgttccagttcgcggagtaaaaacgattgaccttcaagtgaagatggtatgctgatcatgtgcatatgctcctttttgtctttagcgtccccgctctgcggtatcttcatacggcgtccgggaagaaccgggagcggcagacagacgctgaaaagaggtgacggcgcattcaatcagaacatacgtcacaattgcggagagagcggcttccgttgaaatatagaaaacggcggcatagagacagcacttcgtgatcagcgtatgcatccggccaatcttcagtttcagccggaccatgtccgtaaacaagccgagagggaaagcgaaaaacaggatggtttgcaagagggattcgggagacagttttagtgccgaatagacgatagcggcggaacagacggaaatgaagacatgcttacataaaagccgcatcaattcatcatcacacctttcacggtttaaaaaaggctgacccgtcatgctgagggccagcccttctttttatttttcaaggcgtttttcaagctctgcttttttctcttcaaagcccggtttgccgagaagcgcgaacatattcaccttataggcttcaacacccggctgatcaaacgggttgactccgagcagataaccgctcatcgccaccgctttttcaaagaaataaacgagatatccaaatgtatatgcgttaagctccggaatattgacaattaagttaggcacttttccgtctgtatgggcaagcatcgtgccttcgaacgcttttttgttgacgaaatcgaccgttttgccggctaaataatttaagccgtcgagatcattttccgcttcttcaattgtcagctcatgcttcggtttttcaacgtttaatacggtttcaaacagatcacgtctgccttcctgcacgtattgaccgagagagtgaaggtctgttgagaagttagcggaagaaggatagatgcctttttcgtcttttccttcactttcgccgaagagctgcttccaccattcagcaaagtattgcagcgcaggctcatagttgatgagcatttcaatggttctgcctttattatacagaacgttgcggacgacggcgtattggtaagccgcgttctcttctaattccgagctggaaaagtctttgcttgcatcaagagcgcctttcatcatttcatcgatatcagccccgcttaccgcaatcggcagaaggcctaccgcagtcagaacggagaaacgtccgccgacatcatcaggaataacgaatgattcgaagccttcttcattagaaagcgtttttaaagcgccgcgttctttatctgttgtcgcgtaaatccgcgctttcgcttcttcttttccgtatttttcttcaagaagtttgcggaaaatccggaaagcgattgcaggttccgtcgtcgtgcctgacttagaaatgacattgatagagaaatcagcgtcttccaaaagatccataacatctttcatataagttgagctgatattattgccgataaagataacttgagggtttttgcgcttatctttcggcagaacattatagaaagaatgattgagcgcttcaatcgccgcgcgggcgcctaagtatgaaccgccgatacccacgacgagaagcacgtcagaatctgatttgattttttcagcgctttttttaatgcgcgcgaattcttctttatcatagttttcagggaggtccacccagcctaaaaagtcgcttccggcgcctgttttttcatggatattatggtgtgccgtttttacgaaatcacgtgcgtatgtaagttcatgttcattgaaaaaaggtaacgctcttgagtaatcaaagcgtacatgcgtcatttgcttgtccctccatcacggtgaattgttttctctttcactttatatgaactcacccgctaaatcaagtcatgaagaaggcatgatgaatacgggatttgcgctgaagatgcgctcattttttatacaatatcccggattcgaaatagttatatttgtaataatcgtgaaagaggtaacgaatcgaatgttggtgatccaggaacgtatcacctttactttggagcaggttgacatccatcgccaataccgatgggacggttctttttatatagtactcctcttgagaggctgctaagcaggcatattaaggtataaatgtccatttttaaaaatagtgtctatatttgggttatcatgttaagatgaaaataattttaaaccgggaggtgattctttgactaaaaccattggtcttatttgtggaagtttacgaaaaaactcgtataatcgagtgattgctcaatcattgattgacttcgataatgcggctcaatttcgctgggttgaaatagacactcttcctttttttaacgaagatttagaaatggccggagcaccagactccgtaacatcctttagagctgatatacgagacgttgacggcgtcatcattgtaagtccagagtacaattccggaatcccggggtattaaaaaatgcattggactgggcatcgtgaccgcggacctcttccgttttaaacagaaaaccggttggcttaatcggcgcaacccccggagggttcggcacctcttttggtcaaatgcaaacgagagaagtactcgaagctatgcaagtcaatgttctgccctttcaaaaaatgctgatttcgcaagtccatgagaaaattgattccgctcaacacatacttacggatgaacaaacaaaacgttatcttcaacgctatttacaacagttcatccattggattgatcatgctccggttcccattccggattaattgaaagatcatcaccttcacgaaaagtcacttcagaaataactttctacctatacagtatatgaatagatttaccgttttccattgacaaactgacttgccttaattcaaggaggatgataaaatgtctgatctttattcccgtctttcaaaagatgattctgccgtgcttttagttgaccatcaaaccggccttatttccggtctcgtgcgtgactatggcgttgatgaatttaaaaacaatgtattggctctcggtgatacggctaaattctttgatttaccggttattttaacaaccagctttgaaaatggacccaacggaccgctcatgcaagaactcgttgatctctttcctgatgcgccaaaaatagcccgtcccggacaaattaatgcatgggacaatgaagactttgttaaagccattgaagcgaccggcaaaaaacagctgattatcgcgggggtggtaacagacgtctgcgttgcttttcctgcgctttctgccattaaagcaggctacgaagtgtttgttgtgacagatgcttcggggacgtttaataagcaagtagcagatgcatcattaacccgtatggctcatggcggcgtgcagcttatgaactggttcagcacagcatgcgagcttcagcgtgattggcgcaacgatgttgaaggttttggcgcattagtctccagtcatcttcccggttatcaaaacttaatgggaagctatatgggggcgcagcgggaccttagtacacaaaatgcataaaaaggagcgctgattgaatcagcgccccttttttaaattcgcggctcttcatcttcgtgatttagatttcgtgtaaatagatgacagacaatcgcaaagttaattggtcctttacggatgaaacgatttccatagttgtctcatggaaaagggtgtttcacttgctcctaatgaactaatagaaaatccggaaagagggactcccaaaacggttacatctgcagcttgaaaatcactccggccgggaatgtatcttacagtgacgcctttaagatggcaagtacatcatctttgttcagtttttggaaattgccgaatccgccgtattccatttcttttgcggcgatgtctgcgatcagctcaagcttgtcttcgccgatgtcataatccgcaaggcgggacggtgcgccgaggcttgtccagaacgcggacaatttatcgatcccttcaagcgcaatttctttatccgttttgccttcagtatcaatgtcaaacatattaagcatgaggtttttaaaacggtccacatttgtatcaagcgtgtatctcatccagttcgggaacagaatcgcaagtcctcccgcgtgagggatgtcataaaccgctgatacggcgtgctccatcgtatgggaagcccaatcgccgaaatagcccatttgcagcgtgccgtttaatgcgatcgtacccgcgtataaaatcgtttcgcggtgcttatagttctcaaggtcttccaaaagtttcggcgctgtttcaattaccgtctgaaggaccgcaaaacacattctgtcctgaagcggcgtgttttcaacattgtggaagtattgttcaaatacgtggctcatcatatccaccatgccgtatacggtttggttttccggaacgctgaaagtattctcgggatctaaaatggagaaacgcggatgagtgacattgctgccccatacgaatttttcgtttgtttcccaatttgtgataacggaatcagggttcatttcagagcctgtcgccgcaagcgtcagcaccgtgccgaacgggagcgcgtcctgcgccgttacttttttgctgtaaatgtcccatgcgtcgccgtcatatttcgcaccggccgcaatcgcttttgtacagtcgatgacacttccgccgccgactgcgagaaggaaatcaatctcatgctgtctgcacagctcaattcctttatttaccgtttccagacgcgggttcggttcaacgcccgcaagttcatgaacggctgcgccttcttcttttaaaatgcctgttacttggtcatacaggccgtttcgcttaatgctgccgcctccgtaaacaagcagcacgtttttcccgtattgcttcagctcttttttcaattggtcgatttgaccttttccgaaaatcagtttcgtcggattgcagtacgtaaagttctccatttatcatgacctccaaaaaaatcgtaagggaattactataacacagaaaaaaaggagctgccaatccggccgcccccctttatgttattacaatgatgctttcagtatcgcaagcacatcttctttctgcagtgacttgaactgtccgaatgctccgtttgccatcgctttatctgcaatcgtatccagcttctcatcagaaatatcgtaatcagcgagtctgttcggagcgccgaggctcgtccagaattcagacagcctgctgattccttcaagtgcgatctcttcatctgatttgcctgtctcgtcaatatcgaaaacacggacggcaagctgtttaaagcgggccggattttctttgagcacatgtctcatccagttcgggaacagaatcgctaaacctccggcgtgcggtatatcgtataccgctgataccgcatgctcgatgttgtgtgtggcccaatcccctcttgcgcccattgacagcattccgtttaatgcgatcgtgcctgtatataaaatcgtctcacgaagctcatagttctccagatcgttgatcagcttcggcgctgtttcaatcaccgtgcgcagaagcgattcacacatccggtcctgatacggcgtgtttgacgtgtggtggaaatattgttcaaacacatggctcatcatatcgaccatgccgtaaatggtgtggtctttcggaacggtaaatgtgtttaccggatcgagaatagagaatttagggtaaacgagcgggctcccccatccgtatttctcttgtgtctcccagtttgtgatgactgatccggagttcatctctgaaccggtcgccgcaagtgtcagcactgttccgaacggcagcgcttctttcggctggtgttttttcgtgacgatatcccacgcgtcgccgtcatatttagcgcccgccgcgatggctttcgtgcagtcaatgacacttccgccgccgacggccaataagaaatcgatgctgttttctttacagatcgcaacacctttgttcaccgttgagacacgcggattcggctctacgcctgccaattcatgtacggtaactcctgcttttttcagcaggtcggttacttgatcataaagaccgctgcgcttaatgctgccgcctccgtatacgagcagtacgttctttccgtacggcttgatttcttcaggaagtttttcgacctctccctttccgaaaatcaatttggtcggattccaatatgtaaagttttgcatgacatctcctcctttggatttatattatgcagaaagttgacgttcaatgtaaagcaatccgcttttttgacggcacatcacacggtttacagacagcggtttcccgggaaaggcacttgtacagcttgagacagtgtgtgatttacacggcggagaatgtagtatgcatagattctttgctttgtcacaatctataactgtttcacgaatttatagaggaggttgtttacatgagtgttattcagcgtatctgtctcgtattaacgattatcggcgctattaactggggactgatcggatttttccaatttgatttagtagcagccatcttcggcggccaaggatcagctctgtcgcggattatttacggtcttgtcggcatcgccggtctgatcaatctcggcctgctgtttaagccgaacgaagaaacatcccgcgaggaagcggcaaatccggaagtcagataaacataaaaaaagcaccgaacatacatatccggtgctttttttgatggttattttttgataaggtctttgcggttggactgttcaatccactcttcaagcttatctttcaatgtgttgaaaccttgcggagcagatgtttcttcagaaacttgtgccgctttcggttttcttggtttgctttcttttctttcaggcgccgcttgagtcgcacggatagaaaggctgattttgcctttttcttcgtcaactgcaagtacttttacttgtacttcgtcaccgatagaaaggtgttcattaatgtcttttacgaaaccgtgagtgacttcagaaatgtgaacaagtccttgagtttcttcatctaatgcaacaaacgcaccatacgcttgtaatcctgttactttaccagtgtaaacactgcccacttcaaattttgctgccattcataacaactcctaagttaaattaaatacagattatacgcaatttaaaattatatcatacaagtttgtttttcgcaaagagaacttttttacatcatcatgtttaagcgcagataaagggggtatactatgattacgaaggctttctagtattccccccttttatttggatgcgaaccgggttcgtatctttttttatgcccttttttcaacaaaccgtttgattctgacgagcgcttcctgaatctgctcaatggatgtcgcataggaacatctgatgtagccttcgccgctcgggccgaatacattccccggaacgacggctactttttcttcaatgagcagctgttccgcgaattcttctgaactcatgccggtcgactgaatggaaggaaaggcgtaaaacgctccgccggggtggtggcagccgagtccgatttcgttcaatgtttccacaatcaggtttcggcgtctccggtagctttttttcattctttcgacgtcttcctgaccgtttttcagcccttcaagcgccgcgtactgagccatggaaggcgcgcacatcatcgcgtgctgatgaattttgagcatggcatccctgatcacgggaggcgccgccgtaaacccgagtctccaccccgtcatggcaaacgctttggagaaacctgaaatcaaaatcgtgcgttccttcatgccgcggatggctcccatgctcgtgaatggctcatcatacgtcagctcggcataaatttcatcggcaagcacgatcaagtcatgtttttcagcgaaggaagcgatggattcaagctcttctttcgaatagacggaaccagtcggatttgacggcgagcatagaagcagcgcttttgttttgtccgtcagggccgcttcaaaatcggctgctgatgctttgaaaccttttgcagctacagtctgaatcggcaccggcttcgcccccgtcagggtcacgagtgattcatatgcgacaaaacacggttcgggaattaacatttcctctccgggattcataatggcgcggacagcgagatcaagcgcctggcttgcccctaccgtaacaatcagttcactgtcaggcgaataactcaggccgaaccgctgatctaaatagcggctgatttcttctctcagttcataaagacccgcatttgccgtataagccgtataaccctgttctaaagaaagaatactcgcttccctcacgttccaggccgtcacaaagtcaggctctcccactcccagtgaaatgacgccttccatcgtagcagccagatcaaagaatttgcggatgcctgacggtttaatctgctgcacgtagtcagataaataagaagtcttcgtttccatttacggagacaccacgattcttttgtcatcgtctccgctttcaaagactttgccgtcatgcttatattttttcaggataaagtgcgtcgtcgtggaaacgacggactcaagggtggacaatttttcagacacgaagcttgccacgtctgacatcgtgttgccgcgaataacgacagataagtcatacacccctgacatcaggtacactgattcaacttcctggaatctgtatatccgttcagcgacttcatcaaagccgacatttcgtttcggagtgacttttacgtcaatcatcgccgtgacgccttccaaaccgtcgactttgcgccagtcgatcatcgccgcataatcaatgatgactttttccttttcaagcttttcaatgatgcttttgacttcttcggcgggaatgttcgccattttcgcgatcgtttccgcatcaacgcggctgttttcgtctaaaatttctaatatttctgtttctttttccgtcagcttcatacgtttcacacctttgcattatcaaaaatcttcatgacattatatcacgattttcgacaaatgctaagaaaaacccgaaagaaaccagaactaaaatctgacaatcaaaaaagcctttacattacaacaaagaaaggacggcgaaggctctcatggaagctgtttcaccgattaaacgggccgcgatagacggagttgaactgtattacgagcattatgaaaatcccggcagacagacactcgtctgcgtacacggttttttatcttcggcattcagcttcagaaaactgatcccgctgctcagaaaccattatgatattatcgccgttgacctgcctcctttcgggcaatcggaaaagtcacggactttcgtatatacttacgcaaacctcgccaagcttctgatcggacttctggaaaagctcggtatcagccgggccgcactcatcggccattcgatgggcggccagatttccttatccgcgtctcttctcagacccgagcttttttctaaaatcgtcctgctgtgcagctcggggtatttaaagcgctcgcacccgtcgattatattcgggacgcacctcccttgttttgacctgtatcttaagtattggctttcaaaagacggtgtgctgaaaaacctgttaaatgtcgttcacgaccggacgcttatcgatcaggaaatgattgacggttacgaaaaaccatttacagaccgccagattttcaaagcgatgacaaggttcatcagacacagggagggcgatttagagcccgaggatttgaagaaagtgcaaaaccccgctcttttaatatggggagaagaagaccgggtcgttccggtctcagtcggaaaacggcttcatgacgacctgccggattccattctgtattcactcaaggatacgggacacctcgtacccgaagagcgcccggagtttgtttcggaacggatttttgaatttattcaataaaaaaaaccggcggaaccgccggtttttaaggggtgcaggagctgctttcttttatgaacagaagctgctcggcggccttttggcagccttcgatcggtagcttttgctcaaatgaagcttcaaagatatcctgaatggctgctgccagcttgtcggcacggtcttcactgtagacggcctgaacgatgtcgacggcttctgtctcataaaaatcttctccatatttaaatgggtcccacttggcaatgattttcatcatttccatgaccgcttggctttcttccattttcatcaccgcttataataaagtttgcaaatctattttatcatagatacgctgtgcaaaataatgatactacaggagtgacatacatgaactttgatcttcgagaaaaccgtcttggcacacaatcggtgaaatgggacaaggcggaagcgttattcggcgtatcggatgcacttccgatgtgggttgccgatatggatttccgcgctcccgaagcggtcactgacgccttaaaagcccgccttgaccacggcatattcggttatacgtctcctgacgaaaacacaagagaagccgtcgcttcatggcttgagacacggcacggctaccggcccgatcccgcaagcatcacgttcagtcccggggttgtcacggcaatcagcatggcagtacaagcctttaccgaaccgggcgatccggtgttgattcaatcaccggtgtatacgcctttttatcagatgatcaaggaaaacaaacggcaggttttacataacccattacgggaagagaacggcgtctactgcatggattttgaggatcttgagaaaaagctgagcgattctgaggtcaagctgatgattctttgtaatccccacaatccgtccggcagagcgtggagccgggatgagcttatgcagctcggatcgctgtgcgccgctcataacgtcaccgtcgtttctgacgagatacattccgacttgatgctgtacggaaagccgcatacgccttttgcttctctgtctgaggagtttgcgcggatttccattacttgtgtcgcgccgagcaagacgtttaatattgccggcattcaggcatccgccattatcattcccgaccgttataagcgggcgaaattctccgccgcattgcatcagaacgggatttccagcctcaacacatttgcggttgcagcaatcgaagcggcttatacaaagggaggcccttggcttgacgcactgattccttacattgaaaggaatatgaaattggctgaggactttttaagaaaagaattgccgaaagtccgcatgatgaaacctgacgcttcctatttgatctggatggatttcagcggatacggattttcggatgccgagctcaaagaaagaatgctcaaaaaagggaaaatcatattagagccgggaacgaaatacggaccgggcggcgaaggatttatgagacttaatgtcggctgttcagccgccgccgtaaaagaagggcttaagagaatgaaagcagcgctctcttagcagcggaaagaacgcctttatcagatgagataagggcgttcgctttagagaaataaatactttttttgccggtaaagatgttataatagattcatatttacataggaaaggatttcgcataaatggagattgtaaaggattacctgcttcacttctcttttattttattccctatttttctctatcaagtcttctggctcagcaagcccgatttgcttgtgccgagagcgaaccgcctgctggtcgccgtatttgcagcgtcatcttccttattatgtacggcttttcccatccaggagcttcattccgtccgttacggtttgcagctgattcccattatcgtctgcctgctttattccggtaccgcagcaggacttgccgcaggggcagcatccgttttttttcagctcatatggtttgaaccttccgctctttttttcttatccttaattccttttttaatcatcatccctatccagctccaaacgaaatggccttttttctcaaagcggaagaaactgcttttcgctcttctcatcggctgcactgaaaccgccttattaaccgcatctgtcttcatctattccgcgaccaatattttcaattttcaaaatctatcttccgtttattatgaggcggcagtatccgttttttttcaagtcagcgcccttttgctgtgcatttatttgattgagatcattgatgagaatgcgtccatgcgggcaaggctgattcactcagaaaaaatggccgtcgtcagcgagcttgcggcaagcgtcgcccatgaagtccgcaatccgcttacggtcgtcagaggttttgtgcagctgctgttcagcggcgagcagcttcaggacaaatcccactccggatatcagaaacttgtgctgtccgaactcgaccgggctcagacgatcattacgaattatctcgatatggcgaagcaggatgactatgaaaaagaaaagtttgatatttctctgcttgtaaaggaaacaggttccttaatggagtcttatgctaattttaaatcggtgaccgtgactgttcaaagcgagcctgatttatatgtgttcggcgatgtaaaaaaactgaaacaggccttcattaatctgattaaaaacagtattgaagccgtgccctctgaaaacggccgaatcgaggtctccgtccaaaaacaggaagagatgattctcattcagattacggataacggaatcggcatgtccgatgaagaactgcagaaactcggcaaaccgtattatacgctgaaaacgaatggcaccgggctcgggcttaccgtgacattctcgattattcagcatcatgaaggctccgtctatttcaccagcggcgagcactcgggcacaacggcttcagtcaggcttccggcagctgttcactagccaatcgcgttgatcttttatagaataactagagagaggtgaacgctatgaattcgtttgaaatcggcacaatcgtaaaagggttttataaaacaggagcatacataggggaagtgacagacgtcaggcccaatcactatttagtgaaaattaaagccgttctgacgcatcccgctcaaggagatcttcatcatccgaagcaggcggatgttccgttctttcatgaaagaagagcgcttgcattcggggaacagacaaacataccgcatcagatggtcaaaccgtttgatggcgaagttcctgattatacggcttccttacaagcggcgtctgcccggctgaaagatcagcttacagcggacggctcagaatgggcggaacgttcgctcgccaacttggccgcgttagagcgtgactattttaaaagaacttgacccagtcggcatgattgggtttttttatgtggcccgtcgaaacagttcagtcagatcgacgcgatcaccgatcgtcgggggtttcggtttttcaagatattgtttatcccgctcgacaagcttgaataatttgtatgtcgtccgcgcatcatccagcgctttatgatgcgtgcccgtccctttatcgccatactcttccgccgctttccaaaggccggtcaatgttctgtcgccaaagaagtttttatattctagggacagatcccgaagttctcctttgaacggaaaagggatgtggttaaacatgcaattttgctttaacactttcatatccatattgccccaggtgacgatcgtgcagtttttatcaggatcaagctcatttaatttgcggatgaattcattaaacgtgattccgccgtccacgtctttttgggtgatgttcagaaaggttttgcatcgtttcgtcagctttggaaattttttcggtttgatataactcgaaaacgtttcagtcacttcatcattcaccgtcttgacaatccccgcttcaataatctcgggaaagaaattttgcgggctgtattttccgtcaggcatcgtaaattcaaaatcaataatgagcagactgcgctgatccacttttttacacctgcctttcctccgatcaaaaatgatattttatgatagtatatcagtttcccctctgaaactttcttcattttctaaaaataatgaattttcctatatccgcatcgaaaatacaaataccggattcattcctatatactaatgattagacacacgaaaattaaagaaggtgatgttatttctgtccgtaagaagaacttcgtcgtcatttggattacaaatttctttatttccgccagcatgaccatgattgttccgtttctttcgttatatatcgaaacgatcagcccccattcgggcgggtatgtgcagagatggagcgggtatgtgttcggcgtcacgtttttaatggcgtttgtgatttccccgttttggggcagattcggcgataagcgcggctacaaaaaaattctcttgatcacaggcaccggcattgccgtcagcattttattgatggggtttgtgacatccgtttatcagctgtttgtcctccggctgcttatgggccttgtaacgggctttgttccgacttcgcttgccatgatttcggcgcagacgccgaaagagactgccgggaaaacgctcggcacgctgcagatgggtcaggtgtcaggcactttattcggaccgatgctgggcgggctgctcgctgacagcttcggatttacgtacacattttttattacgtcttttgtcattttcgcatctgtgcttctcgttttatttcaggtgaatgagcagccgctcggcgagaaacaaaacaagcggaaaacctattccagaaaacaggtgctctcctatatttttcaccagcccgcgctttgggcgatgatggtgcttaccatgatcgtgcagaccggcaatttcagcatccagccgctgctcgctttatatgtcaatgagctgcacggacctgttaatttagcctttttctccggaatggcgttttcagcgaccggactcggaagcttattgcttgcccggaaatggggggacttcggcgaccgcttcggccacagccggatcttaatcgtgcttttgattgcatcagcggtgttttttattccgcaggcgctcgcctcctccctctccattctgttagtcttcagatttctgttcggcatggtcatgggcggcacgctcccctgcattacggccgcgatccgcgtcagggctccgggcagcatccagggagaggtgctcggatataacgtcagctttcgttttctcggaaacgtgctcggccctctgctcggaggtgcggtctcaagcggtttttctatttcggctgctttctacgtcaccgcctttctcttttttataggcgcggggcttttatggatggcgggacatctgcaaaaggatacagcgtcaaatgcgggctgaccggcagcgatcacgatttcttctaaatttaaccttctcgtattcttaaaagaatgatacgatatggctagaaatcaggagaaaagagagtgaccatggtacgtaaaataatcggatggattttgctgctcggcattatcccgttgtgtgcatttacagttattgcttccggcaaagaggtaaaacaaatcaagccttttgatcaggtgctcgataaacatattgatttaaaagcgatcaacctggttcaaaacagttacatgtatgacagggacggaagccttgtttctgagattgtcagcgatcatgagaaccgcgtgatcgtgccctttaataaaataccgaatgaggtaaaacagctgtttttaacctctgaagaccgccatttttatgagcataaagggtttgactttatggggatggtcagggcggccgcctccaatttcaaagatcataaaattgaccagggcgccagcaccatcacccagcagctggcaaggaatgtgtatttaagccatgaacgcaccttcagccgaaaactgacggagctggcctattcctatcagcttgagaaaaaatacagcaaagatgagattttagaaggctacttaaatacgatttattttaataacggtgtatacggtgtcggttcggcggcacaattttatttcagcaagccgctgaaatctctcactttgggagagatggcctttatctgcgccatccctaataaccctacattatatgatcctctcaagcattttgattatacgaaaaaacgacaagtcagattgcttaacggattgaaaaaagcaggcgttatatccgggaaacagctgaaaaaagccgaaaaggaaaagatcaagcttgatataaacgaaaaaacaaataaatatcctgactatgtttcctatgtaaatgatgaattcacacagcttgtttcctcatccgaaggctatgacaaacgtcttgaaaaagcttccggaaaggcgaaacaaaaaatacagagtgagctttccgacagagtcagcacattgttaaaagacggcgtgaagatttatacggcgctgaatccgtatatgcaaaaccaggtcgtcgcccaagtgaatcaaaatctgccgtatgcaggcgtccagggcggagcggccgtgattaatcatcagacacatcagattatcgcgctttcaggcgggaaagattatcataaatatgatttcaaccgcgcctatcaagcatacagacagcccggttcatccattaagccgctgcttgattacggaccttacattgaaaagaccggcgcaacgccacacagcaaaattgacgcaagcaaattctgcagtgcggattactgcccgcagaactataataaccgcacatacggcacggttacgctggaaacggcgtttaaatactcgtacaacacaccggccatcagaatcatggaccgcgtcggcgtcaataaggcgttcagctaccttgaaccgtttcatttcgcgaagctggtcagcgcggattaccgcctgcctgcggcgctgggcggttttacaaacggcatgacgccgcttgaaatgaccaatgcgtacaccacgttcggcaacaacggcgtttatacgccgagtcacgcgattacaaaagtgactgatttaaaaggaaaaacgatattaaaatggaaagatgagccggcgcaggtattcagcgtgcggaccaacatgcagatcaaagaaatgatgaaagccgtcgtcaaaagcggaacaggaaaaaaagcgaactttaaagctccgtacgtcggcggaaaatcaggaacgtcaaatgactatcacgatatgtggtttgtcggcctgacggacgcttatacgatgggggtatgggtcggcaaggatacaccgtcaagcgtcgaataccttcatgacgcaagccctcagctttcgatctggaaaaacacgctgcaggcagcttattaaagataacggaggggatccgctttgaaaccagctcagcttccggaccgcgtgcttttgtttgacggcgtctgcaacttatgcagcggcgccgttcaattcatcattaaacgcgatccggccggcaaaatctcatttgcttcattgcaatcagataccgcccgggagcttttggcatcagaaggacttccgacagaacaatttgacagcatgatttttatcgaaaacgggcggatatacaaaaaatccgcagccgtgttaaaggtttcgcgtcatctccgcggagcctggcggctgtcagcggtttttttcgcagtgccccgcccctcagggacagagcctattctttcatcgcccggcgccgttacaaatggttcggaaaaagggaagcatgcatgctcccctcccctgagatcaaaaacagatttctgtcttaacaaaaatggctagcttacacaggtaagctagccattatgctattataaagcttgataaagatgtacaaaataccgataacaaaagtaaaccaaaacagaatctcaagcaatataaaaccgatcagcgaaacgatcgagagtgtcgaatagattctgtacaccatgaaaatcaaataaatgagcgtaacaacggcaaataacgccgcaatccaaaaaccattctgcacgaacgcaaaggaaagaattcctccgcctacataaattaaagagcctaatctgatttttttcagattgtccccctcagggtcatttgtgaaaaacaaaagagacagctctgtcactgtgtttgcaatcagcttcaaagccgaaaaaagcataaaatacacaagggcgaacgctgcaaaaagcgccagtctgatccctttctcagagaaataatccagcatcccctgatacatgccgagcgtctgaagtatcttcatgacataaagcgaggtagaaatggataatgacgaactaaaaagcagaatcgcaacgagcggaaaataacccgtccaataagtatttttcatataaaaagtccctttctgtaatctacctcacttattatggaggacttaaaacacattgacaagataaaaaattccatttttcctcacttttacgaaataagggcctgatcttcacaaaccggctttttcggagtaaagtagaacgcgggaatgataaacgtaaggaaggctgttatgaaaaaaacattaaaattgcaaacccggttaacgatattcgtctgtattgtcgtccttatcgcactttgtatcacctttttcacgatcagcgtccagaccgcggaccgcgtgaaagaagaagaacggacaaccgcgctgcgcaccgcaaagcttgtcgcggaaacaccgagtgtcgcgcaggcattgcaaacaagaaaagggctgaaagagctccggaattatacactggatgtccagcatacgacaggaaccgaatttgtcgtggtgatggatatgaacagcatccgcctcacccaccccgacgcaaataaaatcgggaagaaattcaccggcggagacgaacagccggcgttgcacggccatatcaaaacgagcacatcagcgggaactctcggaaaatccatgagagccttcgtaccgatctatggaaaagataaaaaacaagtgggcgtcgtttcggtcggaatttcgcttaacaaaatacaggatgtcgtcagccacagtttgagaccgctttatttcatcatctgcgtaagtatttttgtcggcgtcatcggagccgtcattgtcgcccgcaccgtcaaaaacattatgtacggtcttgagccttatgaaatcgccaccctcctggaagagcggagcgccatgctcgaatcaacgaaggaaggcatccttgcggttgacgcgcggggaaaaattaagcttgccaatgcagaggcgaaacgactttttattaaaatgggtattccgactaatccggtcgatcaagatgtgaacgatattctcccgaaaagccggctgaaacaggtgattgaaacgaaaaaaccgcttcaggacagagatatccgcattaacggacttgagctggtctttaatgaagttccgattcatctgaaaggacaaaccgtcggagcgatcgccacgttcagggacaaaacggaggtcaaacatttagcagaacagctgtccggtgttaaaatgtatgcaaacgcattaagagcccagtctcacgaattcatgaataagcttcatgtcattttagggcttgtccagttaaaagaatacgatgatctcggcacttacattaaagacattgccattcagcagaagacggaaacaagcgagattataagtgatgtcaaaagtccggttctcgcagggtttcttctgggaaaacaaagctacatacgcgagcagggcgctgatctggacattcagctcggcagcctgattccgaatgcggcggatccggccgtcatccatgagctcattacgattatcggaaacctgttaaacaacgcgctcgacgcggtggcgcagatgccgaaaaaaaacattacgtgctcgatgcggtttcaggatcgccagcttgacatagagattacggacacgggagccggaatgtctgcggcagaccaagcccgtatttttgaacaaggttattccacgaaagggacaaaccgggggttcggcctctatttcacccagcaggcaacagaaaatttaaaaggccatatgattgtgacaagtgaaaagaatgaaggaacgactttcagtcttcgcattccgtatgaaccgaaggaggaaaatgatgattaatgtactcatagttgaagacgaccccatggtgggtgaattaaataagcgctatctcagccagattgaaggatttcagctgaaagggatcgcatcatcctttcaaagcgcgctgcacgtgctgagcgagcatcatatcgatctcatccttcttgacatttacatgccgggaaaaaacgggcttgagcttttaacggaaatccgcaagcagaatgaatcggttgatgtcatcgtcatttcggccgcaagcgagctggacgtcattaaaaaaacgcttcggtacggcgccgtcgattatttaatcaaaccatttgaatttgaccgctttcaaaccgctctttccgactacagacgcaagcagaaagtttatcaatcacacagaagcatgacacagaaagaattggatgccgagctttttcaaaagaaagaagcggcggaaaaggttcaccttccgaagggattgacaaagagcacgcttaaactcatctgggcgagcattgagtctttcggcgacggctcttttaccacggaagatctcgccaagcatactgaaatctcgcaagtctccatccggaaataccttaaatttctggaagacatacaagtgctgaatgtagagatggcgtacggcacgatcggcagacccgtctttcaatatcatatcaacaccggcaatgtcagcagcatcaaacaatatttataatgtcaaaaagcgccgtttcgctgtgaacggtgcttttttactgtcatatcccgtgacaaaaggcttgagattcctttttgatatgctatataaggataatgacccggctgatcctcctctgttttaaccagatgaggaagccgattcataaaattgatattttttaaaaaataagcaaatttctatttatttatggcgggtaaaatgataaattatgattggttagcagatcttttcagataagtcataagtcccgaacccggaagagacagccgctcaaggcgggaaaaagagagacgtctcatcattattatcagaaagttttttcgattctgcatccggcacggggactcaagtctgaattgaacggcacagccatattttacaggggggttatatctttgaaaaaacgcaaaatcggaatggcgatggcgctcatcgcagcggccggaaccatattaagcgcatgcggttcaagtgacaaagcaaacggctccggcagcaaaaactttaccgtcggcatggtaacggatatcggcggtgttgatgacaaatcatttaaccagtccgcctgggaaggcatccaggcattcggaaaagacaacgggcttaaaaaaggcaaaagcggttttgactatcttcaatcaaaatcagatgcagattatacaacgaacttaaataaattagcgcgggaacactttgacctgatttacggcgtcgggtatctgatgcaggattccatcagcgaaatcgccgatcagcgcaaagacacacattttgcgatcattgacgccgttgtcaaaaaagacaacgtggcgagccttacatttaaggaacaggaaggttcattcctcgtgggagcggccgctgcgctatcgagcaaaacgggaaaagtcggattcgtgggcggaatggagtccgaattgatcaaaaaatttgaaatcggcttccgcgcgggtgtacaagccgcaaatccgaaagcgaccgtcgaagtgaaatatgcgggcgggtttgacaaagccgatgtcggcaaggcgacggctgaaagcatgtacaaatcaggcgttgacgtcatttatcacgcggccggcgcaacgggaacgggcgtcttcacagaagcgaaaaatctgaaaaaagaagatccgaagcggaacgtatgggttatcggtgtcgataaagaccagtacgcggaaggccaagtcaaaggaacaaaagacaatgtcactctcacatcaatggtcaaaaaagtggatactgccgtggaggacttaacgaaaaaagcgagtgacggtaaattcccgggcggcaaaacattaacatacggtttggcgcaagatgcagtcggcatctcggatcacaaggagaacctttctgacgatgtcatcaaagcaacagacgattggaagaagaaaatcgcggacggactcgtgatcccttcaactgaaaaagaattgaaatccttcaaggctgagtaagaaccaggggataaggagactttcgtgcttatcccctctcttttttgaaaagagcggtgaaggaaaagctgcatctcttgcagcttttcttttgccaagctctttctcatcaaagtatctctgaaaaggagcgacaaatcggtggattatatcattgaaatgcttaatatacgcaaggaatttcccggaatcgtcgccaatgatgacgtcacgcttcaagtgaaaaaaggcgaaatacacgcccttctcggtgaaaacggcgccggaaaatcgacactcatgaacgttttattcggcctgtatcagccggaaaaaggcgagatccgggtgcgtggcgaacgcgttcacatcaacagtccgaacaaagccaacgatctcggcatcgggatggtgcaccagcattttatgcttgtggataccttcaccgtctcagaaaatatcattctcggaaaagagccgaaaactttcggccgaattgacagacagcgcgccgcccgggacgtgcgtgatatttccgaccgttacggcctgcacattgatcctgaagccaaagttgccgatatctccgtcggtatgcagcagcgggcggaaatattaaagaccctctaccggggcgccgacattctcatttttgacgagccgaccgcggtgctgactccgcacgaaattcaagaactgattcagattatgaaaaatcttgtcaatgaaggaaaatcaattatcctcatcacccacaaattaaaagagattatggaagtctgcgaccgtgtcaccatcatccggaaaggaaaaggcattacaacacttgatgtcgcacatacggatcaagatgaactggcaagccttatggtcggacgcgaagtgtcattcaagacggataaacagccggctgaaccgaaacaagaagtgctttcgctttctgatgtaacggtgaaagacgcgcgcggcgttgaggcggtcaaacagctctccctctctgtcagagccggtgaaatcgtcggcattgcgggcgttgacggaaacggccagtctgaattaattgaagccattacaggtctcagaaaaacaaatgccggcacgatcatgttaaacggcaaacagctgcaaaatatgccgcccaggaaagtcactgaagccggaatcgggcatattccgcaggacagacataaacacgggctcgtccttgattttccgatcggagaaaatatcgtgctgcaaagttattaccaaaagccctactcttctttcggcatattaaataaacacacgatttatgacaaagcgcgaagcctgattgaagaatacgatgtcaggacacctgatgaatatacgcctgcgcgcgctctctccggggggaatcagcaaaaggccattatcggccgggaagtggacagaaatccggatcttttaattgcggcccagccgacgcggggactcgatgtcggcgcgattgaattcgtccataaaaagctcattgagcagcgtgacgccggtaaagcggtgcttctgttatcttttgaacttgatgaaataatgaatctcagcgatcgcatcgccgtcatctttgaaggcagcatcatcgcaaacgtcaatccgcttgaaacaaacgagcaggagctcggacttttaatggcgggaagtaagcaaatggaggcggggaaaacacatgattaatcgactttctcatctggctgtgccgctgattgcgatcatccttggattagctgcgggtgcggtcatcatgctcgccagcggctacaatgtcgtaagcgggtattcggctctttggagcggcattttcggtgaagtgtattacatcggggaatcgatccggcagattacgccatatattctgtccggattggccgtggcattcgcatttcggaccggcctgtttaatatcggggttgaaggacagctccttgtcggctggaccgccgcggtgtgggtcggcgtttcctttgacgcccccgcttacatccaccttccgctttcgttattggcggctgcggctgcgggcggcatttggggcctgattcccggatttttaaaagcccgtttttttgtccacgaagtgattgtcacgatcatgatgaattatatcgctcttcatttaaccaattatctcatttccgatgtcatgacggaccaccgggacaaaacagacaaaattcatgaaagcgcgtcgctccgctcgccgtttttagagcagctgacagattactcccgccttcattggggcattctgatcgctctgtttgcggcagtcctcatgtggtttatcattcataaaacaaaaagcggatttgaattccgggctgtcggctttaaccagcacgccgcacaatacgccggaatgagcgtcagaaaaaatatgatgtacgccatgatgatttccggggccttcgcagggcttgccggcgcgatggaaggactcggaacctttcaatatgcggcggttaagggcgcctttaccggcgtcggcttcgacggcattgcggttgcgcttctcggcggcagcacggcaatcggcgttgttctggcggcatgtcttctcggcggccttaaagtcggggcattaaatatgccgattgaatccggggtgccttctgaagtcgttgacatcgtcatcgccattattattttgtttgtggcatcaagctacgccatccgtctcatccttgataaattgaagaaaaagggggcgaagtaagtggacttcctgcagattttatccattattgttccggcaacactcgtatatgcggctccgcttattttaaccgctctcggcggcgtgttttctgaaagatcgggggttgtcaacatcggtcttgaaggactgatgattatcggcgcctttacaagcgtcatgttcaacttatttttcggacgcgagcttggcgccgccgctccgtggctcgctctggctgcggctatgattgccggcggactgttctcactgatccacgcggctgccgcggtttctttccgcgccgatcagacggtaaccggtgtggcgatcaatatgctcgcgttaggagcgacactgtttatcgtcaaactgatttacggaaaggcgcagactgataaaatcccggagcccttttacaaaacgaacattcccgggttaagcgatattccggttttaggaaagattttcttttcagacgtatattatacgtcgattttagccatcgtactggcctttgtttcctggtttattttattcaaaacgccgttcggccttcgcatccgttctgtcggggaacatccgatggcggccgatacgatgggaatcaacgtgttcggcatgcgctatatcggcgtcatgatcagcgggctgttcggcgggctcggcggcggtgtgtatgcttccacgatcgcgcttgatttcacgcactccaccatttccggacaaggctttatcgctctcgccgcgctggttttcggcaaatggcatccgatcggcgcgctcggggctgcgctgttcttcgggtttgcgcagagtttgagcattatcggctcgcttttgcccctgttcaaagacattccgaatgtatacatgctgatggctccttacattctgaccattctcgcgcttgccggcttcatcggccgcgcggatgcgcctaaagccaacggcatcccttatattaaaggaaaacgctgattgccacacaaaaagagttccgcaccctggtgccggaactcttttcatctatatacgattctgatatactcacgcggctgaaacggcgtttgcattgattcagccgcactcagcttgtcttctgcgtattccgcaccgagaaaaaaatgctcccaatcatctgcttccgtctgctgccgcgttttgcagaaatcatcaactatgaatgttcctgcaataatagaacaaaatattccaatacaggccgccgcctttctcttcatctgaccagctccttttgtaaagcttgatctgaaaaagaaatgtatatacaaagatccggatatttgataaatttattttgggttcaaaagaccacaaaaacacaaagaggaatacattatgccgtagcagggtaaaaaaaagtgcgatataatttgtactgggtcctatgaccgtgaattgattgattcattcttacataaagcagttgcttgatgaaaaaacaagcaaaggaggtcttctgttgcagctgttacatttcgcgattttggcgccttttttatttgcatttatcgttccctttctttataaacgggtaaaacaagtccatacaggctggtttgtgctgatagtgcccgttgtgctgtttgtttactttatcagcaagctccctgtcacaatggctggagaaaccgtccggtatgcggccgaatggattccgtccctcggtattaactataccgtttatattgacggactcgggctgttattcgctttattgattacgggcatcggctctttggtgacgctttacagtattttttacttatcgaaggacaaagaaaagctcggccctttttatgtgtacctgctgatgtttatgggcgcgatgctcggcgttgtgctcgtcgataacgtcatcgtgctttatatgttctgggagctgacaagcctgtcatccttcttattaattgggtattggcataagcggaagaaatcacgctacggggcggaaaaatcactgctgattaccgtcggcggcgggctgtgcatgctcggcggctttatcctgctgtatctgatgacggattctttcagtatcagggaaatggtcaaccaggtgcatattatcgcaggccacccgttctttattccggcgatggttctcctgttattgggggcctttacaaaatcagcgcagtttccgttttatatctggcttcctgatgccatggaggcgccgactcctgtcagcgcctatctgcactcggctacaatggtgaaagcgggtatttatctgattgccagattcagtccggtttttgctttttcacccgtctggttttggacggttgcctcagtcggtctgatcacgatggtatgggcttcctttaatgcgattaaacaaaccgatttaaaagcgattctggcattttccacagtcagtcagctcggtatgattgtatcgatgctcggcgcaggagccgccgcgcttcattatgagcattcagagtattttacggcggctgtcaccgcggctgtgtttcacttaattaaccatgctacttttaaaggaagtttatttatggcggccggcattatcgaccatgaaacgggaacgcgggatatccgcaggctcggcggcctgatggcgctcatgccggtaacgttcaccgtttcactgatcggaacgttttccatggccggtctccctccgtttaacggctttttaagtaaagaaatgttctttacaagtatgctgcggattgctcatgcagatattttcagcctggatacgtggggcgtgctgttccccgttctcgcatggatcgggagcgtcttcactttcatctacagcatgaagctgtttttcagaacgttcagcggcgcgcgcaaaacggatcagcttgaaaagacgccgcatgaagctccgctcggcatgctgatttcgccggtgattcttgccgcttgcgccgtcagtctgttttttgctccgaacgttttgtcttacagcctgattgaaccggcgatgaactccatttatcccgctctgttaaccggcggagatacattccatgtccatatttcccagtggcacggggtgacggctgaggtaatgatgaccctcggcatcatcattgtcggcacgatcggttacgtaacgctgtctaaatgggagcgtctgtacggtctgtttccgaaaaaactgacgctgaacaagctttacgatgcggtgacgggcagtatggaaaaaagatcttaccagctgacgtcatcttatatgaccggatttttgcgggattatctgctgtatatctttgcgtcgtttatcattctcatcggagcggcgttcgtcatgaaaggcggcttttccatgacagcgaaaggaatggctgagatcggcctgtatgaaatcgtgctgtccctcgttatggtgaacgcaacgattgcgactgtgttcgccaaatcacggctgacggccattatctcactcggtgttgtcgggtacacactcgcgctgtttttcgtgattttcagagcgcccgatctggcgctcacgcagctcgtcattgagacgatatccgtcgccttgtttcttctttgtttttaccatctgccgaaaatgcggcggaaaaagaagacaagaacattccggatgacgaattttatcatttctctcggtgtcggcgtcatcgtgacaatgctcggaatcgcgtcttccagcgaaaaaacaaaagacagcatctcctcctttttcaccgcttacagccataagctcgggggaggaaacaatatcgtcaacgtcatcctcgttgatttcaggggatttgacacgatgtttgaaattacggtgctgtcgattgccgcactcgggatttacggcatgatcagaacaaaagtaacagaggagggagaaaagcgttgagacagccaaaaacaaacgacatcatccttcagacggcaacgaagcttgtatcttttatcattctgcttttctctttctatttatttttatcggggcataacgcccccggcggaggatttgtcggcggactgattacgtcttcggccatcgtgctgctgcttttggcctttgatttaaaaaccgtcaaatcgattttgcccgtcaattttatttatgtggcgggcgcgggtctgcttatcgcgattgcaacgggtgcaggttcgttcttattcggagcgccctttctcacccatacattcggccattttcatctcccggtgctcgggaatacggagcttgcgacggccactttgtttgatttaggtgtgtatctcgttgttgtcggcgtgacgatgaccattattcaaacgattggagaggaagaatagtggaaatcttaatgtctgtcattgccggtattttgtttatggcggcaacctacctgctgctttctaaaagtctgctgcgcgtgattatcggcaccgcgcttttgagccacggcgtccatttgctgctcctgaccatgggcggactgaaaaaaggcgctcctcccatactgggcggaaaaagcacgtcctttgtcgatccgctgccgcaggcactcatactgacggcgatcgttatttcgttcggcgtcacgtccttcctgcttgtgatggcgtttcgcgcctatcaggaactgaaaacggacgatatggatcgaatgaggggaaatgatcaacatgaataactttgtgatattgcctattctggtgccgctgcttgccgcagtgctgctgatttttatgaacaggcacgtgatgctgatgcggatattcagcactgccgcttcctgtgtctccatcgtcatcagcgccgctctcgttcagacggttttcacacacgggattcagacgctgacactcggcggctggaaagcgccgtacggcattgtgctcgccgcggatcagcttgccgcactgcttgttttgacaaccgccataatcgggctgctcgtcaccctgtactccttccgctccatcggagaaaaaagggagcgcgctttctattattcaggggtgcagtttcttctggctggcgtaagcggagcgtttttgacgggtgacctgttcaacatgtacgtcttttttgagcttctgcttatcgcgtcctacatgctgatcgtgcttggcggaacgaaaattcaattaagagaatcattgaagtatatcgtgtttaacattgtgtcatccgcgttttttgtcatcggtgtcggttacttatatgcggtgacgggcacgctgaatatggctgatctaagcgtaaaaataagcgaatcgggccagaccgggctgataaccgtcatcggcatccttcttctcgtcgttttcggtttaaagggcgggatattcccgctgtatttctggatgccgggctcttattacgccccgccggctgcaatttcggctttattcgggtctcttttgacgaaagtcggcctgtatgccattttaagagtattcaccctgatctttattcacgatacgggctttacccaccaattgatgatgtggcttgcgatgctgacggtgctattcggcgtaatcggatctatcgccttttcggatgtcatgaaaatcgtcatctacaatattattacagccgtcggcgtgattttgttcggcattgccatgaacacgccggcctccattcaaggagcggtttattacttgattcacgatatgctgattaaaggagcgctgtttatgcttgccggcacgcttatcgcattgacaggcactgccagcctgcataaaatgggcggactgatcacccgttatcccgttttaggatggatgttctttatttcagccatatctttggccggcatcccgccgttcagcggatttgtgggcaagctgaagatcgcggaaggcgggttcgataagggggaaacattgttttccgtattgattcttgtatcaagcctgcttgtgctctattcggtgctgaaggtttttacgacggctttttggggcgaagaaaaagaaatccccggcgcaggcggacggtccgcaaaaggacttctttatccggcagccgcttttctccttttgtcgcttctgttcgggctcggaaccgaatgggtttcaccgtatgtcaatcagacggctgagaatctgctgaatccggaaaaatacattgaagctgttttgaaggagtagatggcatggcttttcaactattattaaacgttcttctcgctgtttgctggatgtttctcacaaacagcctcagcacggcgggttttataaccggatttatcgcaggcttggcggcgctgttttttttccggcgcttcttctcgcggccgttttacatttggaaaatatggtcagtcatcagactggtgctgatctttataaaggaattatatttggccaatgtcagcgtgctgaaaaccgttatagcgccgaaactgaacatccgcccgggcattttcgcgtttaagacggaattgacggaggattgggagatcacgttgctctcgctgttaatcactttaacaccgggtacgctcgtgatggatatctccgatgaccggtcgattctctatatacacgccatggatattgaagatgcggagaaagcgatccacgacatccgcgtctcttttgaaaaagccattcaggaggtgagccgctgatgtttacgtttattctgcaattatcactcggcattatggcggtttcgactcttctgtacgtcattcgcgtcatgaaagggccgacgataccggaccgggtcgtcgcgcttgatgggatcggcattaatctgattgccatgaccgcgcttgtatccattctcttaaacacatcggcctttttggacatcattctgctgctcggcattttatcgtttatcggcacgattgcctttgctaagtttttggagaaaggagagattatcgaaaatgatcgaaatcgttaaatgggccgtcgccgtttgtattctgatgggatcgctgatctgcctggtcgcgtctttcggcacactcaggcttcctgatgtgtatacgcgcgcccacgcctcttcaaaaggctcgacactcggcgttaatttggtattgctcggggtgttaggctacttgtggatgctgaccggagaaatttctgtaaaaatactgctcggcatcatttttatcctgctgacggcgccggtcggagcgcacctcatatgcagggccgcgtacaattcgggagcggcgcttgataaaagaagcgttcaggatgattacaaagggatcagaaactttgtgatcaaacgaaaagaagattcatatttgtaaaaacaaacagccggacgattcagggttccggctgtttgtttattttgttataacagccagcgtacagcgggaaacacagatcagcctttctcgttcatcgaaaatgttaatcccgtacacaatggttgccctgcctgtgtgaacgggttccgctatcgccgtgaccgttccgccctctttcactgactttaaatgattggcattaatctcaagcccgacacacgcctgtttcgaccggtcgataaaatgctgggccccgacacttgcagcagtctccgccagcgctgctgacgcgcccccatgcagatatccgaaaggctgcaccgtcctcttatccaccggcatcaccgccacgcatctctccggcgtgttttcagtgatttcaataccgagtgcgccgagcaatgtattgttcagattcataggtcattctcccttcaagatttatagtacgttatctgacttggcgatcagcaccgcttcagttcgggagccgacattcagcttattaaaaatggatgtcaggctgtattcaatcgaccgcttgcttaagtgaagcgcatctgcgatttcctgattggtcaaacctttttcgacctcttggagaatatggcgctctctcggggttaaccgatcctgctcactttgaggggaagaagacgtttttgttttttgctgggtcatcagctgtttgaaataggagaaatcaactaaaatctgtccgttgagcacgtgatatatgtattgcatgattttctctttagattcggttttgctgatggcgccatgcaggcccgcgcggatggattcttcaaaataatcttcaacctcatagcctgtgtagacaatgattttacagagaggattctcttttaagattttcttggaaagctcgatgccgctgatgtcatcacccagatttaaatccattaatatgagatcgtaagctgaaaaatcatgccggagaacgaattgttcactggcatcaggactgaggcaatcgacagaaagattcgtgtccgtttccagaatcgtcttggtgccctccatgacagccggatgatcatcaatcactagtatctttttcatggtttcctcccttttactcactcatttccattttattaaaaagacttggcttctgccaagtcgatttggtgataaaatggttacaattccatttcaatatccgctttaaaaccgtttccttcacttgtgtcgattttcatccgtccgtcaagcgcacggacgcgctccttaatacccgaaagacccatgctcatcgactgtccgccgccttcttcctgattgcagccgacaccgtcgtcttcataatgcagaatcactttattttgaatgctgatcagcataatcagcacctcattcgcctgtgaatgcttcatggcgttcgaaagaaattcctgaataatgcggtacaaattcagctgcgtatccaaatccagcgccgccgtaaaccggcccgtattcagacggatatgaaacggcgcacgctcttgctgctgcgcggcaagcttggataccgccttgaccagacccaaatcatacagcagctgaggccgaagctcatggcacgtctcccgggtcatcaaaatgacatccgacatctgctcattcatctgatgaagcttgtcctgcacctctaactggcaaggctcctctttcttaaaatcggccagaaacagctcacactggcgcttcaaagaaatcaaatcctgcagcactgaatcatgcagatcacgggccaaatccgaacgctgcttttcctcgatcgtaaacatcagctttttgagccagaccgggtttgagccttgttgtttcaggtcttgtaaatggttcatgagttcttcgatctgcaatatgttttccatcgaaacacttgtataaaaagacaatgtctttaaccaagatatctcatctcttgtcagtctcggagtattaatgctcgacaaacaaagcagaacgtatgagtttgcccctctttctccaatcttcatcagaaaaccttgatttacttcaaaaatcttgccaatctctgatgagactttaacaaattcttttttatacggctgccagttcggttcactgttctgtttatcaaaatacagaatatctccgtcagaactgatttcaaagatatatgccttactgacaggcaacacatctaatatcgtctttttaagattcataaacacttggtttaaagctgatacgcttttaagaagctgtgtatatttaaatatgctgtcttgataattatatttttctgaaaaacgtttcaggcgaaatttgtagtctaataactccttaatataaaataccgctaaaaaaatcaaaaatacatatacagtgatttgaataatgttaaagttattccccttgctgtcgaataatatattcagccatacaactccaatagtcggaataatggaaaggaaaccatagtatctaattctgcccaacaagaagtctatatcgtagattttattgaccacgaattgatagactaaagctaatggaataattattaaaaatggtgccgtaactatagcagaataaatatactgtccgaacaacacctcaggtataatataaaatactgtaaacggaaaaaaggctatggtattagatataagtaatactttcagcaaataaaagtgatccttttttcggtagactagtccataaaaaataatggatgtatagacgaccatcatttccaaaaaaaatgttactaaattaatattcgtaacaagttggaaggcaaaatgcttctggaatatctcgattattatattaataaccggcaatatatagagagtagacacaacataaccagctgaaaatttcaattttaattctttaaagtattgatacaaaaagtgaaagtataatacaggtacgttcaaaaatgtaaaaaggttaatatatctgtttatttcatatcctctagttactccacctgcgcttaaatatgcaatggatgtacacaataaaaaaataatcaaaataaaggctgaataagtatcttttactctgttaactttataaatataaaaaatgcataacatgcttaaagcaaataatatgcatgggataatatagataaaaaaactataagagctatttaaggaaataaactcagtattatgtaagtctattttactattaccccttattattttcatatgttcagctttcgctagatattgacctcttatattctcttctgtcggtgtttttccgcttatttcaattatcctgtctccctcttttaagcccatatatttaccatacgtagacttggagagttttacaacctgcaattcatggttattgttttcaaccacataggttcctaccaaaattccgttttgagtaaaatatataatatgagcgacgtaaaagagactgacgaataacaatacaatcgaaaaatttctaatgaattttttcaatagatctcactctctcaatcattgttcccaaaaaattcccctgcatttttttgattgacttaagtccctttcaaaaatctcaacaatggcaggtaacagtttatccggaactcctattaaactagcttccccacacgctaactttgtaagtacaagtggattttccataagataatgtacgatatcttgcttcactgtaatttcctccattaaagttctaacattatatttaaatcttttatacttgtcgtaatttcttcctcgtacattttaattaacattgaaacatactggctaactcctgcatcaaatagtaggtcttcaaggctttttttattatcaatgaggaatgaatggtaacttgcttctgcattcattaaatccaagattttttctgaagcagcattaaatcttcgctttagatacaacagaattaatgtttttcttccctttctgatatcactacgatttttattaaaaagaccataataatcattttcaatctgtttaacaattccaattttataggaataattctcaatttcttcgttaaactccccatttgcaagcattgttcctaatacagctgacattgcagtaagcgagcctgatttttgtttaatcatttgaagacattcgtcttcagtttcggggaaattttcgaggtcattatgctgaccttgcattgcatttaaagcatatttcatagcaagccggggaaaatcggagttcgttttaagctcacaaatcacttgaagacttattgaataaagagaagtggctgcatttaaagagatagattgatctatcttcatccattccttatccaagttatcttcatcctctatatcgtcaaaaatatcaaaagctaaaattaacaattcaattcctgaagctaataacgtaatatccgaataatgctcaccatcgaaagccacataatgcttaaatgcaagaacaccaaaagcaaaatgatttttttcatttataaaagtctgaagggtgtcttttaaatgtggattatttattttctcctccacaatttccttcatcttctctttaatcgtttcggcatctaaacacatttgctcaataattgtcttcaccctcccattctattttactaaatgcaggtgatgaaagacagcaggtttttcgttttttaacaatcgtataatactttatccatgaaatggataaaaaatgcacaaaaaaaagacttgtttccaagtctttttaagaaattttcattgcatatgagaatttatcgagctgatcaatgcttttgttaatgtttcgtaatgagtcggttgtttctctgatatcattttcaagtcggaataataattgctttacttcttctaatttgttttccaccgtttccacactcctttttttgaaagatcaatgaattgtgtatggtgaacgagtcctaggtatttgatctgttactaatagtgtaaacgtttttgcgggatttttcaccgaaaagtatgtgtaaaagtatctgcgtgacaccgcaaaccaaggtaattccatagtcccgaacagggcatttagcgaacaggactatataactaccgcaaaggcagacgtttaggataaagcagaccaatctggcggttctgctgttttttcaacggttttccgacaaaccggcagggactatagtccctgccgtcacaatttcaaaacagaatgggcaaacagcgtcgcataaccaccgacaaacaccgaaaagaccgcaacccccgcattgtggtctttttgcatgtcataactcattatcacgccgcctatactcatgtataacgaatgttttctcaggaaggaggccgccgtatgcattatgtgtatccatgctgccctgttttcgccgcgccataccggcatccagcgcccagtgccccggttcacgcagatattttgacagcgtccgcaaaagaagctgcgggcatgctggaggatgcgcgcctgctccttgcgcggctgtcggcgtcaaaagagcttgcgcgcagcatcctcaccgcagcgcaatcatctgacaccgcagcggtcaagcggctcattaagcagaccggcatcaaaaatgactttgacgtgacgtataatcccgacggcatccgtgtcagtctgatcagagagcaaagccggtttatcatcgccctcagatggtcggcttaaagcggctcaatcgatcagctgccggcaccattcgatcgcctgtaagtaacattcatacgcttcttctttgttcagttcttttccccactcgtcacagtcccagttgttgcattcaatggctttgacgagcgcgagcatcttataataatcgttttcataaccgagcagcgcctgtccgacttcatcgattaaaggcagttctttgatgatatcctccagttccctgtggagaagcgtatcgatgagcgaaaacatgccgatcagcatgtaagaagagggctggggccttccggttcttttcgccagcagttcgcacagtttggccctgattaaggaaatcttaatgatttctttttggcttgagtggcttttcgccgttaaatctctgaatgaaagaatgtaaatcaagcgcttaatctcattcagcccgagcatcatgatggcctgctggatgctgtctatcttttttttcagtcttgtttgcgatccgtttaaaaaacgcagaatctgatacgataagctgacgtcacgctctatgtattccgtcacgcgctgtatattaggctggtcattgtttaattcgcttaaaagctggtagtaagaatgaaaatgaaacgtcagatcatttccgctgatgacacgcggttcactgaaaaaatatccttgaaacaggtgaaagccgtctatggccgcctgtttataatcttttctcgtctccactttctccgctaaataaatcagacttttacagctgtacgtctgaatgatttttttgcgctccagacgcgaggattgcaaaaagtcgatttttaaaatatcaatatatttcatcagctgttccactaactcttcattttccggattgatggcgtaaaaatcatcaagtgctaatgtatatcctaatttcttcagctgtctgcatcttgagatgagcgccggagtgatcggtatgtcctcaagaatttcgataataagctggtcaggatcaaaggaggtagggagatctgaaaacatcaggctttctgtaaaattcacaaagcagcgtttcccctcagtcagcttttcgattccgatgttgataaagctgttaataatgagatccgtcgtagctttatctccatccgcggccgaataacggttctcttcgctctcccggtaaagaagttcataagcaacaacctgttcgtttctgttgaagataggctgtctcgcaacaaacaccttcattcatttacccccttagatgcggccttcgaacataagtatatcaaataacttgacgaaatttgtctaaatgtgaaaaatattatcacaacaaaaaagcctttccagagataggaaaggccgctttgttttctattcaagttcccgtttcagcttgcttttgatttcatgaatccgctgcatcttgttgctccagcagtcttcgcttaaatcgaccggatattcttccggcttgctgatccgtttgtattcctcccacagaagtttgaggttatcctgcacgtattgctggatgtcggtaatttcgggattatcatagcataaaacgccgttttcaaagatcggctcatgcaagtctttcgcatagaagtcagtgacgaatttgctgacgaacgtgtggacgggatggaacatttttaagcgtttctgatcatttacccgctcgtcataaagcgcgatataatcaccttccgagtggtgattcagcttgttgataatccggtatactctctttcttcccggcgttgtcactttttcagggtttgacgaaattttaatggtgtcggtcagtttgccgtcctcttcaatggcgacaagcttataaaccgcgccgagagccggctgatcgtatgcggtaatcagcttcgtgccgatgccccacgtatcgattttcgctccttgggatttcaggtttaatatcgtgtgctcatcaagatcgcttgaagcaatgacctttgcgtctgtgaaacccgcttcatcaagcatttcacgcgctttttttgacaggtacgccaagtccccgctgtccaggcggatgccgatgaagttgatccggtcgccgaattcctttgcgactttaatcgcattcggcatgcctgaacggatcgtatcgtacgtatctacgagaaatacgcagtctttgtgggtctccgcatatttcttaaatgccgtatattcatcgcggtacgcttgtacgagcgcatgagcgtgcgtgccggataccggtatattaaaacgctttccggctcttacattactcgtcgcgctgaagccgccgatcaaagccgctctcgctccccacatggccgcatccatttcatgggcgcgccgcgttccgaattcgagggcgtcttcatcaccgacaacgcctttaatgcgggccgctttcgtggcgattaatgtttggtaattcacaatgttaagcagagccgtctcaatcagctgcgcttcaatcaggggtgcttcgacccgcataatcggttcattgttaaaaacgagctcgccttctttcatgctgtaaagagatccggtaaaagaaagatcccgtaaataatcaatgaaatcatcagcatagtgcaattccgtttttaaataattcagatcgctgtcggtaaatttgaagttctccaagtattcgattgctttttctaagcccgcaaataccgcatagccgttttcaaagggaagctttctgaaaaaaagctcaaaaatcgcttttttctcatgaatgccgtctctccagtacgtttcggccatattaatttgataaaggtctgtatgtaaagacaaactgtcgtctttaaaaccatgctccaccaaaattgttttccccttccttactctgccacttgcgctccgatgctgttcttaaaatgggacagggcccattcatgcccttccggattaaagctggccacagcgttttgatgaatgacgatctgaaagcccttgttgtaggcgtcaaccgccgtgtgaagaacgcagatgtcggtgcacaggcccgcaagatgcagctcagtgatctgccgttcccgcagtttcagctctaaatccgttcccgcaaaagcagaatatctcgttttttccatataatttacgttttttgcgtgtttatgtttctcataaagaggcgatagccttccgtacagctctttgccctccgtgccgttgatattatgcggaggaaacaggcgtgtctcgggatgaaagtcatcgtctgcatcatgcgaatctaccgcaaagacaacgtaatcaccgttttctataaatgcttgcgtcaaactgacaatcgtatcttcaatctgtctcgcgggttctccgcaggttaatgccccgttctcagctgcaaaatcattcgtataatcaatgcatataaatgcttttttcatagccggcctccccgccattcatatgaaaaccattatatcctatctccacttgtaagtgaattggcattgtaaaatgacaaacagtgttttgcccttttaagatttcaggagtgagcgctgaaaaatgtcatcctgcacgtaaatgccgtcaaggttcacggcataatcggcggcaaaaaccaggccgagcggcgtttcgaattgaaggtccgagatgacggagcttcggacaccggcaagtgcggcaagcttcatatatggtgaataagcatgatacgggagccttccgtttatatagagcaccgcgtcttttcggcttttcagcgcctgtttcacttcttcatacggctgcttttgcagcacctgtcccttcgtcagggcaatgatgactctttcacgcagcgagcctaaaaataaatggcgttcatccggtttcgtctgcaaagggccgtacatcccctgctgtaaataaaggtcaaccgttttgtcgctcatcggcctgtccctcccagcttgttttacaattatcgccccggacgggacgcggtaaaccgttttcgttacatttcagccacccaatgggagatcttgccggcgagctctccggcgggttcttcttcaatcagcttgctgaatgattgtaaaagccgctgcgccagcgcctttttctcttcctcataggaaatgatcgtgctccactcaagttccggaacggctacaagggtatgctgttcttttttattttcatgcagatatacatcaccgatcattccggactgcacggtaatattcgcttttctgattttcataaaacattccccttttataaagactgattctattatactacaaaaaagcgacagcctcctaaaaggaggctgtcacgcgttaaaccaatcaggttcgtcaaacacatcaatgtcttcaaagcgcgttttgctgaatttattagtaattttgacaaaatctccggaatgaaacgcccctgcccccgcgcctgagtggtcaacggctttgggagaaatggcaaacacgtcaccgaagctcgctgcagcgtctccggctaaactcataatataaatcggtcccacaattgcaggcatacccacacctccgcttttctttacagcattttatgcgctgcaccgggagttgtgcccgtttttatttcggcttgcggctgtcttcgagctttgaccgctgacgaagtttgataagccggacgatatttaagacgaaagcttttaaaaccgcgtaaaccggcacggccaggatcattgcgagaatgccgccgaaactgcccgctccgataagcagaagaataatggtgagcgggtgggtattcagccgttttccaatcacaagcggagaaagcaggttcccgtcaagctgctggacgacaacgacaacaataacggcaaacagcgccttagccggcgaatccataaacgcaataatcaccgcgggcgccgccccgagaaacggccccaggtacggaatgatattggtgacggcgatcaccatcccgagaattaacgcatacggcaggccgatgatccaatatccgataaaacatgccgttccgacaaagagacaaatcagcagctggccttggaaataggcggccaatgtgacatataagtcgttaaatattttccgaccttccgcccggtaggaagaaggcagaattttgaccgccaagagcggaaaccgccggccgtccttcagcatataaaacaaaatgaacggaacggtgatcacgacaagcgtgatattcgtaacgacgccgaacacggccgacaggcttgccgtaatattttgcggaaggctttgtaaaaatcccgtcagagactgctggattttttctatcgacacataatcctgcgtcatcatccacgtaaaccatttggaatgggataattgcgccgtcaagacttgaatctgatgaatgtaatcagggaaattgttaatcagccccgtgacctgggaagccacaatcggcccgatggcagtgaacataaaggcaatcagaccgatgaaaacgagataaatgagcaggatcgccaatgtccgggggatttttttctcaagcaggcgcacgatcggattaaaaatgaaaaacaaaatgcccgagatcaaaatcggaaaaaacagagtggtgataaaaccgaaaaacggctgaaatataaacgagactttcgttgatacgtaaataatgagcaaaacgagcaaaatttgcagcgtccaaaaatggacctttgatttcaacaagcggtttcctcctattgtcgtgtgaacttgtactgtgattgtaccaaaaaaagccgccgtgcatctatgtatctcaaaaaagaagacgcaccggggttctatagtgccgcctccggtttgcgccttttcgggctgttacacgcgttcggtataatcaggcatgacggaaaccacatggcggtttctgatataaaatacacggtcatgcgtctcttcaatggcgatgtgatccggagtggcatcaatcagccgtcctctgacaatgcgtctgacggtttgaatgataaaccttgagccgataagcttatggatggtctgataaacgtaaggatccactaacgagacgatttgcgggcttccttgatgggccattttcgctgatcccctttactatgttttccttcagcatatgcagcggacaaaggctttgacacagtacgtctatcggagcggaaaaggtgttagtgagcatgcggagttatgtaagcggaaaaggccgcatgagtggcctagactgagcttcttatgggatattgggctcggtcaattaactgatcaagcttttggatttgtttgagcgcggccgtgtgatccatttggcggtaatggtgatgtccgccgggttcttcatcgagttcatccgcttgtttcacgatttgctggagcgtattcttgtccagttcgccttcaggcagataggaatcggtgtgaagcagaatcgccagcgcaatgtccttcgccgctttcggttcttcaccgagccggatgagcagcttatgcgcccgttccgcgcctttaatggcatggatatcatttcttctgtacttttcataatcccatttgccgtctgtgtaccattcataatggccgacgtcatgcagtaatgccgctttcgccgccagatccgggctgacacctgcttttacggcaagacggtatgcatgaaacgcgcaggcgatcgcatgggcgacaccggaacgctgtaaatacttttgtgcgattggatgggtgaagacatccattaacgttacatttctcatggaaacccctccttcatatatttttagaatcctaacataaatcgagaagaaactcaattcatctgatacatttcttataccccttatatgttgtttcattcatcatatgccgccggacccctaagtgattgtacaaacaaaaaaagagcagcgtgaaagctgctctacaaaaattctttgatatcgtatatccgtccgttttccggctcgcccgcgatcagtgagtgaatgacgccggcgatgtattcaggacttctgaggtttttcgtttctttcagattgcggaaccgttcgatgtcatggaaatcttcttttgacgaagaacggatgaccgactgcatgtctgtatccatcactcccggcgagaatgatatcatgcggaccggcagctcttcatcttcctgttcaaacccgaatgttctcgtaaacatatcaagccccgcttttgagctgcaatacgcgctccagcctttataaggatttttcgccgcgcccgatgtgatgttgacaattgttttgctgccgctgaacgcttcgaagcgctttgtgaacatttggctgagcaaaacgggcgccgtcaggttaagggtgtaatggcggttcaattcttcggcggaagcctctttcgcccgcttgatcggttccaccattccggcattgttgatcagtgtgacggcggagtaccccttctcctctgcttgatcaagaatcgccttcatctgccgcccggtatctgcgagatcggttaaatcaacactgtattctgtcagcccctcgcgcttttccccgcttatcgttcttgaaagcgcggcgacttcggctccttcttgaagcgcctgttccgtaagcgcccggcccaagccttttgacgcgcctgttataagaaaaaactgcatgaaactcctcctttttttcttattttacgggctgtcttcccgcaaacacaagcgatccgttttaccgctttgccttttcctgcgccgtgactttcgggatcagatagatcattgccgcaatcccgaggaggatcaagacggcataaatagcgggaagcagataagaagtctttttctcttccgtttccatatctgccgaggtatgccgcaccgccggctcggcaaatgtgatacccagttgtttcgattgcgctttgatcgtattcggctccgtgtctgacgatgtaaacaaatttgatatcagtttgtcatccgggttttcggccggctgatcaaacgtgatatccttctgttctttcggaagcgccgttttttcctcggagtaggcatcgtcgtgcaggtagtccgtacgaatttcaatgtctttcttttcatattcattcggcttgacatcagtattttcctcattcgcggctgcggcttggggaaggaaaaggaaaaaggagagagcaaacagcagcaatcctttttccatgaacgtgttacgcctcataagactgatcactttcctccgttttttccgcaaacagccgaatgacgagcggaagcgccgccgcaatcagcgtaatgatcgcaagaaccgttacccccaacgcaaacagatggcccgttccgtattgaatatcgatatagactttcgaaaccggactgtcaaaggtgaagttcggcataatcaggtcgatcaaaggcgccacataaaagagaatgagcgctgatgatgcgatccatccggtaattgagctgaagacaaaggctgcccggataaaagctgaactcgccgcaagcaggagaatcgtaaagactgaccatttaatcgtctgatcatccggaagcgaatagatattcagaccgaacagactgatcatcaatccgaccataatgtttaaaatcccaaagagcgcgcctttgacaagaagcggcgcctgctgataatacgagctgaaatagccgatcagaagactgctgatcaggacgatcaccaaaatgacgaccggcggaacattctgaacccggtcttccggcacctctccgctgattttaagcggattggcgagataatcataaacatatccgttttcctgtccgtcaacgagcgcgttccctaaaatgccgtacacgtcatttctgatcaatttcgtggaatcgacgtttttgccccagttgctgttcagggtgtccgctttttgctggacgtcatttacgctttgctgcatattgtcggtatagctgatgatgccggactggcgttctgacagatggcccatcgtgtcagacatttgcaggacttcacggccgacggtatcctgagcgccgagcgccatcgttccggttaatccgtctccgctgaacgcggccgcttcctgcacagcgccttcagccagctgatcggatgctttcgccgcgctgtctgaaatgctggcaagctcatcgagcaccccggcttgctcatctctgatatacgagctgtagttatccgagaattcggtcatgcctttaatgaaattgctgatgtcttcatcagtctgcattttgttgtttttcagattttcccagcttgccgtttcttccggtttgatggcaagaacggtttggacttcaccttgctgggctttcagcacccggtttttcacatcaggcagcgagcccgcgtcaagagagtgatagagtgtcgcctcatacagggataaatcattatagtaactcattaaatcggatatcttttttgtattgatgtcagcggcaaacatctgttcaagagcagatttgcggccgctatccaatgacgggtagttcagaatgttctgttctgttcttacaatcattctgtaaacggtatcgaagtcttgttttctcgtttcttccaattcttccaaattttcctttaatttatctgcccgtttttcaactttggcaatctgatttttaaggccttggatttcttcatcaagagcatcgagacgttttttcagttctttattatgagtctgctgtttctcttccagctctttttcaatttgctgaatgcgttctgcggcttggttcagcctttcttttgcctcagatatgtccgtgccgccgtccctttcagaatcgtttggatcgtccgccggctcatcagcaggcggagtgacgttttcagcggctgtcgaggtctggacggtttttggctcctgatcgcctgtgttatcggaggcaggctgctcttcttttgtgccgtcttccgtttttccgtcttctccgggagccgttccgttattcggatcggtatcgccggagttttcaccgtcatcgccttggcccggttcttccggttccggtttttctttttccggttcttttaatccgtcagaaatgtgattgatttcagcggagatgcgttttaattcgtcacgctgatcgtcaaggtcaattttcagatcgccgggtttttcttcttccggtttttcttcttctttcggttcatccgagccgtcatcacccgggtccttttccggaacggttaatgccggccgatcccttttcataagggtttgaatgctgttcaatgtttcaaatcttgcttgcgctttatattgagtcaaataattgtccagtaaattggattgaatattcgccatcccgcgttcctgatcaggaacctgcgcttctctcacctgttgggcggcaaaaagagccgatcccgtctggtcaagctgtgtctgcgcccggtttatgcctgaagagagcccgctcatcatcgtgctgaactggttggcggcctgctgtgctttaatggcgttcagtccggttgtgatttgcttttgattttgttcctgcgcggccatcagcagttttttctgattttcttgatattgtttgtagcgctcgaccgtgtcggcaaagtctttgagcgtggttttggcttcatctgccgaagtcagtttttcttttgccgcgccctgcgcttcattcattgattttttcagttcgtcaatcaggtctttttgccgtttgatttcacctgccaagtcattggagctcggcttgtaaaagttgtacatgacattttgaaactctgattctttattgacgatcttgtcaaaatcgcctcggacattgttcactttttgtgagacgaaattccaatataatgccgacatttttttattcattgatttttgggcgtcttcaagctcacgctgcactttttctttgttgacggcgttcaggttgctttgaatattgaatgtcagcgtggctttttgcggacgctccttgtcatagcttaagatgtcttttgaaaaatcggatggaatgtaaacgacggcgtcatatttcttagccgccagaccgttttctgccgcgctcctgttgacaaccgtccatgaataatccggacggccgccgagagcggccgctacttctttgccgaaatggacggattcctcttcctcattttcatctgtttgtaagcccatatcttcattcacgactgcgatttggcgggtggcgttgattttttgttttcccgggtcatcgccgataaaccggaaaaacagcaccggcagcagcagaatgatgacgaccgcggctattaatttgatcaggctttttcgttgttcggtcatctgacggcctccctttccgctgaacataaaggtatttggattttttgctccttcccgttttcaaccaaatagccgaagcccggctgaatgtccggttcctgcctttggtaaggcagcggaatgacattttgttcggattttttcacaagcagcatcgcgtggcggatctgtttcatttccgtcgttaaggaatcatagccttttgagaattcgctgtgattgcccgccgggataaaactgaagcccacatgcgcgtaagatttcataaacatcgccagcttgtcctgtaaggcggtgtcgatcgtctgctggaatcttgtaatgccgtcggccattaacacgaccggagagaaactgagtttgtgcacatcgccatttttgacggcctgcgtatactgagcttcgcgctccgtgaaaatggcttctgccgtttcgatccactgccggacgtcttcttttgtgtccagatagctgacctttgtttcctgcgcatactgcgacagtccgcggtcaatcgagtcaaacagcccgacccgttccgcaccttcacgcagcaggtgattcagcatcactttcaggatatttgtttttccacgctgtgtctggcccaaaataagacaatgcttatttttacccagatcaaagtacacagggctgaccttttcctcatgaagcccgacaggaatgcggaacgggtcttgttccgggccgagacggagtgaaaattcgccggccgtcagcatatccggaagcatcggaatcgggtctggtccggctgttccggcgtggcgctcagctaaagctttgacatcagctttcagcgcctggaacatctcgaggtcattttccgcttcagccggaagaaacatttgcgcgaaatacagttcttctttttggatcatgacgcggcccgggatcggttcgagactgaacggcggacgcccgtaaatggagtatccttctgactgatccattaaataatggacgactttcgtttttatgttgtttaacagcgactggcggacggcgtttaccctcgttgcggtcagcaggaagtaaatgcctaagctttgcccgtcgcgtgaaatctggataaattccgtttctaattcatgcatttcgtctttgacgatgtcgaaattgtcaattgtgataaatataaacggcagctcttcttcactgagcgaattgtacattttgatatggctgacttctttttccctgaacagccgtttccgccgctcgatttcttccttgatgcggatcatgaatttttcgatctttctcatttgatccattaagaaatagtctgcggtgtgcggaagctttgccaatggcagaagcgtgccgtttccgaagtcaaagatgtacatatgaagctcttccggcgtgtatccttccgcgaaattcatcaggaaggtgatggcagccactgacttgccgtagccggatgagccgaaaatgccgatgttgccgtcatccatcattgtgtaagcgagaggcgcctgtctttgctgatcaggctcatcaacgcaggcgatgaagaagcggtctttttcctgcgcggggtaaagcgtgcgcgggatacgttcggcaagcggcggaagccacgggctcggcagcttttcaatgcccatttcattttgaatccgctcgatttcttcgactacggcttctatttctgccggggcgtcttttttcgccgcatcatccgcatccacctcagacagcggaattaagccggtatcggtaacgatggcaatgtcatcctcggtgccgtatacatcttccatgtaaggggcgccgctccaggcagactgaaactgctcatacacttcgttatttccgacttgcaagtagccgcgtccggtgaccgtaatattcgccgcatcactgtttttcaggatttctttactgtcacttgcatcctgcactttcagcgcgaccttaaagcgtgagttgctccatatttggtcgtcaatgatgccgcccggcttttgcgtggcgagaattaaatgcacaccaaggctccgtccgatgcgggccgcgctgacaagctccctgataaagtcaggctcttcgcttttcagctcggcgaattcatctgaaatcaaaaacaggtgcggcatcggaatatccgtttctccctgtttatacagttttgtatagtcattgatgtgattgacgcgatattgatcaaacagccgctgccgttttttcagctcgctcttaatggatgcaagcgccctgatactgaagtttctgcttccttcaatattcgtgatggtcccgagaaggtgcggcattttgcggaacggctgcgccattcctccgcccttatagtcaatcagcaaaaacgccgcttcatgcgggtgaaagtgaacggccaatgacaggatatatgtttgcagaaattcacttttcccggagccggtcgttcccgccagcaatccgtgcggcccgtgcgctttttcatgcaggtttaaatagacgatgtcgtcttttcctttatagccgatcggaacagccagcgattttgcagactcacttgtctcccacttctgcctgatgccgatttcttttacttccttcgcatgaaacagctcgagaaatgagaccgtttcaggaatggaattcgtcattccgacctgatggtgcaatgtccgaagcgtccgggaaaaccgctcgttgtttgtccgttcatgcctgtccagcttaaacgggatctgcaccgcttttttctgttgaatgagaatgtctccctcatcttcattaatgtagcggacgagggtgtgaatgttttctgccaggctttcctttgtttccgcggcaatgatggccgagatgccgagatgctcatgccggccttcgatgtattctaaaatgacgtgctctgcgatcagctgctgatttgtgatgacaaagacaaaatgcggctgaaagatctttttttctttatcctcttccaaatcccgctcccgcagcagctcgtaaatggacgataacaattgatcgcgggtctgttcattgtaaataaatcctttcgcatacatatgaggcagctgaaattgcggcagccacttcatccattcccattccttatattcgtcctcatgaaagataaagacaaatcgcaggtcatggtagctgttgaagaacgcgagctggccgatcagctggtgaatttcatttttgacgatctgaggtttcccgacaagccccatcggcccttcttgtaaatcaacggtcacgggcgcatggcggatgtctttatacacacgctgcatgtgctgcgactgctccatcaagtcatccacatcacggttcgccaggtctccgccgctcattgaaatctcgtagcttgacgggaccgtgcccgttccgagccgaagcatcagaaaatccctgctttccagcgatttctcccaaatgcggccgctgatttcagaagttaaatatttcattttttcaaacgggggaaaatgatgcgtcagcacgtgcagctgtttttccgacagcgtctgaagctctttccgtttgctttctaaatactgcttgtacacacgctcccgtttttcctcccgttttttccgctggtttttttcacggaaatactgcacggtggacgtaatgagagtcatcataaacatcgccaaagagacaaggatgaatatgcccctcggctgtataatagcgacaacccccattacaatcagcatgaccacaggaggcagaatgacgagccacagcccccggttattctgttcgctttcctgcgagggaaagctgaatgaaacgcggtcttcgggaagatcgtagaccatgcgcggcgttcttcgatattgcgggtatttctttttcatttcggtgcttggttttaccgttttggttaaaccggcttgaagcttttcgtgatgaacgatttctaaaaggtcgtcctccgtcagcctcacacgcagaaaattccacagcagctcatctcccgtccggagcctttcgggagcttctgcaagctttccgttcacataaacttcctgaccatcagggacgacagaccagcatcctcccgacttacgcagataaaaagcccctgtttgagcggaggacggctctttgtatatatccgcttcctctgtttctgatgagaaaacgatctcatccttcccgccgataaagtacacggaggattcttcctggtcaggggtgagcagaagccgcatcgtctcttcttcaatccggcagggcatttcatttcctattgtcaattcgccggcacagttatttcccaggaaaacatcataacgatctgtttctttccgataaagggttgcggcgttttgccgtaacggaagtgtgccgaccgtgattgtatctttcatatccggaccgatcgtaatcggctgagagggcgggagttcagacagctgaaccttttgtacgtgctctcggtaaaagacccataacagactcatatggcgaacctcctgacgacagcctgatcgttacatgcggccatttgatgtgtgctgttattttttttcatcttttttctcatctttcttgtcgttctctttgttatctttcgctttgtcttgtttgctttcatcttgtccggcggaagcttcggcggtgtcactgttttcctccgcttctttatgctgttcctccgcctcttttttcgccttcgcaagctcgctttccacggcgtccagttctttctgcttttcgtcgtctttcatactgtcatccgctaataattgctgtttatattttgtaagtccgagccagatgtacgggttgtactcaagattgcggccgattttgatggcttcttcattttcccctctgccgatatcaatccaataaaggaagtgcttcgggtctgattgcagcgtgaccagattcccgatgtttttccgctgttcttccctcagattttcaactgccacataagaggaagcaagctcgtactgcacagattccgggaggctttccgcatcgtatttagcgagtgtgtcaatgactttgctgtactgctgatttaaaaaatagcggttgctttccgtaattgcctcttgcttcggctggacgaaaaacagaacgtataaggagtaaagaagtgccggcacaaggaggacggcaagcgccagaccggcgtatctttggattttccatttctttttcggcagttttatgtatgtcttgtccctttcttcgagggaatcgattgcggtttgaatggcttcttccagttcttcaatcgtctccgcctctaacacgcttttcacctcaggagagaaatgaagcgtctccttgtacttcaaatattcatcgaaggtgtacgccccgtcagctgcaagcgccgcacaggctttgagctcttttaacaccctttctctatcttcctcataaggcggaaggctctcctttacgccgtaatgaagaaagtaaggcgtcagcgctttatcaaacacgatattttcaggggcggcaatcagattgagacgtttcagcttatgctgtttcacggcttggacgagacggtaggcaaattgccacctgctttttttatcttttccttttatatagcggaaagcctgataagaagaaggaggtttgattgtgatggttacttcgtcttctgaaactgagacctctttttgaaaaaaaggatcggcatctttaatcacattcgcttccagcccgtcaagaagcttgattttttcccgctggaaggtgaacgtgaagcctgattcggtttcttcccggacggcgtctaattctgtttctaaataagatctgttatgacctgtcattccaccatgtcctttcataaaatttcaaggcggtctccgttcgtaatgccgcagtcagatagcttttgttctccggaaaaaaccgtttctttattgaccactctgatccaatagccttcacgcggcggaacggatacatgctgagcctgccgggcaatatcaatgacttttttcacagaatggtaatctgacaatctgagatcgaagacgctgccgttataatgtgttaaatctattgtaatatcgatatacatattcatatcacccttacatagaaagagcgccgtcttcttgattgaatcaggcgctccgtttcttcattcatcttattatccgcgaatttggttagcgatatcttggtcggtagactcaagcgtatttgccgtttgatcgagctgatgattcacatcttgaagcaattcagacattttaataaatgaaggtttcagctgctcatattgatccgcgaatgcttcacttgaagcaccttcccacatgcctttcaaatcagaaatcatgcggttcaggcggtcaacctgattcatgacttcctgactttcaacgccatattgcttagccatcgctcttagctcttcgggtgtgacacgaattaatccagacatattccttataccctcctgtgtcatcagcctaaatatgggctaattcacttattttttgaacgtcattattataaaaacaaccaatcggcacagtcaaacaaatctgttttaattttacaaaatgagtcttatgatatattggatttttcgtcataattacacattttgtaaataaaatagtatgattttcttattattttcgttttcactgaatgatcttattgtcctagtctatttccctgcaaagatgcctttcagtctgaaaagcaagatggtaagatcaagatatgaagctatgaaaaagtagggatacagatgaccaatccaaaagatccatttaagtacagtttcgacaggcttgaagatgttgccgaccatatcagtgaagttcttcaatgccccattacaatagaagacgttaatcataaactgcttgcatacagcacgcacagcgattgtacagatcctgcccggacgtcgacgattatcgggcggagggtgccggaaaaagtcatcaacaaactgtggaaagacggaaccattccggcccttttaaaaacggaccagccgatcaaagtgaaagaaattgacgaggtgggcctaagcaaccgcgtggcgatttccatctggaaaaacagtcaggttctcggatttatttgggcgcttgagatcaaaaaaaagctcaatgacgaagatctgaagacacttcagctggcagccaaagcggtgcggaacaagcttttgcacctgcagatccgcaaaacgaaaatcgaagagcggggccaggagtttttttggaaaatgctgaccggccatatttatcaggaagccgagatggccgaagggtttcataagctcggaatggcgctgccgtccgtgttcagcgtcatgatcatccgtttacatgatgagctgactgaaaagacggaacagcagctgcaatatttgcaggaaacgacacagcagattcatgtcatgctggcgactgttgattcaaatgaattaatcttattagccgcgccgaaaaccgatcagccttttaaagatttaaagcacttcgctcttcatattcaaaaacagttgaaggaacgatataaaattgaggatgcgtcgattgcgatcggcggtatttacgaatcgatttcttacgtttaccgatcctatcaggaagcgctttccgtattaaaagcgaaagagcggtttgtgagagaaaccaaacaccttttcagcttttctgaactcggcatttatcagtaccttgatgtgttggatgaaaaacgcaagcacagcggctatatgaactattccctgtcaaagcttgagcagtatgacagggagcaccaagccgatatggtaaaaacgctcgaacattttattgatgccgacagcaatgtcaacaccgccgctaaagcgcttaacatccatgtcaatacattgaattacaggctgaaaagaatcagccagatcgcagaaatcgacttaaaaaatgtgaatgagaagtttacgatttacctggatatcaaacttcgcagcatgggttcgtgaaatttcacaaatccgtgtttttttattttctgtttcaaacaaagaattttcgcaaaaatcgcgctacacttgaagcatcacacaaacattgggggaaacagacatgattatcggggttccaaaagaaatcaaaaacaatgaaaatcgagtggcattaacacctggaggcgtttcacagcttatcggaaacggccatcgggttcttgtggaatccggagcgggactcggaagcggctttacaaatgaagattatgtatcagcaggggcggaaattctggaggacagaaagcaagtatgggatgcggaaatggtcatgaaggtaaaagaaccgctggctgaagagtatgcgtatttccgtcaaggtctggtcttgttcacttaccttcatttagccgcagagccggaattagctaaagcgcttacagaaaaaggtgtgacagctatcgcgtacgaaacggtaacggacggacgttcccttccgctgcttacgccgatgtccgaagtggccggcagaatggccgcgcagatcggggcacagtttcttgaaaaaccaaagggcggaaaaggaattttattagccggcgtaccgggtgtatcccgcggaaaagtcacgatcatcggagggggcggcgtcggaacaaatgccgcgaaaatggctgtcggactcggtgccgatgtgacaatgatcgatttgaacgcagaccgcctgcgtcagcttgatgatattttcgggcatcagattaaaacattgatgtcaaaccctgtaaatattgcagattccgtcgcggaagcggatcttctgatctgcgccgtgctcatcccgggagccaaagcgccgactctcgttacggaagaaatggttaaacaaatgaaaccgggttccgtcattgttgatgttgccatcgatcagggcggcattgtggaaaccgttgatcatattacaacccacgataatccgacttacgaaaaacacggcgtcgttcactacgctgtcgccaatatgccgggcgccgtaccgcgtacgtctacgctcgcattaacgaatgtaaccgttccttacgcgcttcaaatcgccaataaaggcgcggcacaagccattgcagacagccctgcgcttaaagcgggcttaaatacggctaacggacatgtcacgtatgaagcggtagccaaagacttaggctatgactacgtgcctgctgaaaaagcaatgcaaggttcggctgcaaaagcttaatagagatgaagaggacagcctgatcagcgggctgtccttttttctttctcacaaaaggaaaaacggccccctgtctcgaatatcaattcatatcccggaagaaaaaggaggattcatatggctgttcagcactatggtgtattaaaaggcactgtgttagatatgaaaagggaaacagatgatgattctccgcattttcaagtcgaggtgctaggcgagcctgatacgcgctatcgctgtgcgatcaatgtcatgtcaagttcaaaagaatcagaggtgctgtatgcggcacgcgatcattttgacgcaagcgcgatcaccctgctgccgaacattccgtacggatataccccaattgatgaaaccagacgtgagctggcgctggattatgtccgcggcggattgtttgatccccggaacatggtgccccttccgcatgaagtcaccggtccggataatgacttaaatgactttattgagacgtacatgcaaaaagccaaatcagaaaaagccaccgtctatatttacggctctaaattcgggccggagccgggcgctgataagattttcgggttcaagccgacaaacggcatgcataatattcatatgaatcagggaaacccaattgatacacgctggaagaaggataacggaacgtggcacgacggcggtattttaatccagtttgcagaccagtgggccgcggtctttttggcttttctgtctcagtcatggtgcacggatgaagaaggccacccttatacattttgtgatcatacacagcttaacggctgatgtccgcataaaaagcctgccgaaataacggcaggcttttcttattacattttagcagcttcggtccgcttcaggctttccggcctcatatcacgccagtttgtttcaatatattcgagacaaacggggcgggtttcattcgtcaggcgggtttcccagccgtccggcacatccagataggccggccacagtgagtactggccttcagcattgacgagcacatggtatgaaccgtcttcccgttcaaatggatttgtcatatcatctctttcctttctttaccggactgtacgccgtccgtttaatttctctgccagaatcgcgccgatgtcggcaagcgggcccggctggcacatatctttatggcggcagtctaagtcataccgctcgattttcccagtaatatacggtttccaagtatccggctcgatcgggtcaaaccactccggaataatcgtggatctgaagaacagcacatctccgtggaacggctttggcttgtatgttcctaacagcccgacagaatttacgtacgtgtctttcagattcatcatcactgactcgtccaggctggctaatgcgcttccctcacggcggagaatggtcagcgcggtgtcaaaatcaagcggctgatccccgaggctgtccgggtcgtaccctcccagggcaagcagcgcaatgacggcttcctcgtcatcaggcgcattttttatcggcagaaaatgattcggatacgcgtcaagcatcaccaaaagcgaaacctcttcgccccggctctgtaattgtgtcgccatggcctgaatgacattccctccgagagaccagccgagcagacggtacggccctttcggctgcacggtgcggattttttcaatataatcagccgccatgtcatctaagctttgcggaagcggttctttttttccgatgcctctcgcctgtaagccgtatatcggataatcagcttctaaagaagacatcagcccggcataacaccagctgagaccgccggccggatggacacagaacaacggtgtttcttctcctgccgttctgagcggaagaagaacatcaagcgcgcttgtgcccgttcctgactcaagtctttcagcaaggcttgccaccgtaggagcttcaaatagtgttccgatactgagctcggctcccatcgcttcccgaatacggctcattaaatgaaccgcaagcaaagaatggccgcctaaatcaaaaaatctgtcatcaataccgacacgcggcagatgaagcacctctgcgaacagctcacacagcatttcttcctgcggcgttctcggtccccggccggtgacctccgtttggaagtcaggcgcagggagcgcttttcggtcaagctttccattcggtgtcagcggcagttcattcatttggacaaaagctgatggaatcatgtaatccggcaggctttcttcggcaaaccggcgcatgtcccccgtgtccaaggtgctgccggcagatcggacaaggtaggcggccagccgtttatctcccggccggtcttcacggacgactgcggcggcatcctcgacatccggatgtttgacgagaaccgcttcgatttcccccaattcaatccggaagccgcggattttaatctggtggtccgccctgcccatataatcaagagaaccgtccgtccgcaggcgggctaaatcccccgtccggtacattctcgttcccggcgggccgtacggatcagccacaaagcgttcggcggtcaggctttgccgccctaagtagcctcgtgccacgccccctccggcaacatacatttcgcccgtgatccccggaggcacaggctccagccggtcatcaagcacatatacgttcagatcaggaatgccgcagccgatgaggctgtttgctctcagttcggcaatgtttttgtctaattcaaggtaactgacgtgcaccgtcgtttccgtaatgccgtacatattcacgagcaccggctgattgtccgcgtggcggctgtaccaatcctcaagccggctcagctcaagcgcctcgccgccgaagatgatatatctgagtgcgagctgatgccccagctctttgtgttctttttccgcatgcatcagctggtaaaacgctgacggcgtttggttaagtacggtcactcgctctttcacgagaagatgcagaaacgcttccggggatctgctgatgtcatgcggcacgacgacgagacgtccgccgtggagcagcggcccccatatttcccagacagagaaatcaaaagcgtaggagtgaaacatcgtccatacatcatcagaattaaagtgataccaatgccgcgtcgactcaaacagccggataacattgctgtgcggaatgatgacacctttcggcacacctgttgatcccgacgtgtaaatgacataggccgggtgaagcggtctcagcggacgaatccggtcggcattctcagggttcgtgacggcatattgccgaagtgtttccttattctgcggatcatccaggatgaaggccggcatgccgttttcgccagagagcttacttgcgccttcacggttggtgagcataaatacaggcttggcatcatgtaacataaaagcgatgcggtccgcgggataatcaggatcaagcggcaaatacgctgcccccgtcttcaggacggctaacagcccgacaatcatatctaaagaacgcggcagcgccagtgcgacaaactgctccgggccgacgccgcgggcaatcatcatgtgcgcgagctgattggctcttttattcagctcttgataagtgagtccgctctcttcaaatactgccgccgtttcatccgattttgcggcggcctgtatttcaaacagttcaggcagtgtctgccgaggctgaatatgctgttttgcccgtttaaccggcaaaagcttccggcgctcttcatcagaaagaatggttaagcttccgatcggtttatccggatgtgatacggcatcttcgagcagaagaagcaggcgtccggcaagtgcttcagccgtttcttttctgaataagtccgtactgaactccagcaggccttcaataccggcaggcgtgccgtcatcatggcgctgttcagccaattccaatgtcaaatcaaatttggacgatccgacactgctgatttgcaggcttgtttccatatcaggaagactgagtacagggtcaggcgtattttggaatgcgagcatcacttggaacagcggatgtcttgaccgggagcgaaccggattcaattcttccacgagacgttcaaacggcacgtcctgatgttcatatgctgcgagattcatttccctgaccctttcaagaagctcacaaaagctcggatcgccagaggtatcggttctcagtacgagtgtattaatgaacatacccacaaggtctcctaatgcgtcatcactgcggccggctatcggactgccgatcggaatatcggttcccgccccgagccgggtcagcagtgcggaaagccctgattgaagcaccataaacaggcttacgcgctgatttctggcaagtgagagaagacgggcatgaagctcttggccgatgttgaccggaatgacgccgcccctgtagcttgattcagcgggacgcggaaaatcagacggcagctccagctgatccggtacattttcaagcgttttcttccagaaatccagctggcgcgcaattaagctctcagaatcagacgcgctgcctaaaagctgctgctgccaaagcgcataatccgcatattgaaccgccagcggcgcccattctgctttttcacctgtttgccgggcgatataggctatggataagtcacgcatgagcggattcaaggaccagccgtcgcctgcgatgtgatgcaggagaaccatcagcgtatattcgccgtcaccaagatcaaacagctcagcccggacggccggctctttagcgagatcaaaccgatatcttgccgcagcggcaagcatgtcttggagctcgtttttgtctgcacgtgtcactgtaaacacagggcgggcttcttcagcaggtaaaataagctgatgagatgatcccttattttccggaaaaacggtgcgcaggctttcatgacggctgacaacatcgtaaaaggcgtgtttcagcgctgattggtcaagcttgcctgacatgcggacaatcaccggaatgttgtaagtcgggctcggcccttcaagacagtagagaaaccaaagacgcagctgcgcaaatgacagcgggatgtgctccggccggtcaaacggcttgagcttaggccgcgcactctttgcggtgtcaagctgtgcggcgagcccggcaacggtcggggtatcaaacagacgtccgatgccaagctctgcgcccatcgtctcccggatccggctcatcaggcgtccggctaagagcgaatgtccgcccaattcaaagaacccgtcatcaattccgacccgcgcgagaccgagaacctcggcaaacagatcgcataatatttcttcctgcggcgtccgcggccctctgtcagacaggacagctgaaaaatcaggtgcaggcagagcgctgcgatcgagcttcttattcggcgtcagcggcaattctttcagctgtacaaacgcgcccggcaccatataatccggcaggctttcgcccatatattcacgaagtccgccgatatcaaggggctgatccgcgacagcataagccgccaggcgcttatctcccggctggtcttcacggacaataacagcggcctgcgaaatacccgggtatttcgacagcactgactcaatttctcctaattctatccggaacccgcggattttaatttggtgatcggctctgctgatataatcaagcgagccgtcctcacgccagcgcacgagatctcccgtccggtacatcctcgcgcccgcgggcccgtacggatcggcaataaatctttcagctgttaaatcaggacggttataataacctctggcaagcccctcgcccgctatataaagctcgcccgcaattcccggcgggactggctgcaatgcggcgtccagcacgtatacccgcgtgttccaaatcggctttccgatcggaggcgcccctgtatggtcttttgcaagcggctgtgcggccgaccagattgttgtttcagtcggcccgtacagattcgtcaccgtacagcctgattcaagcagagcatgcataagcgcgttcggaagcgcctcacctccgacaagcacctgcagcgcccggagggaatcaggttcattggtgactaatgaatgccacaatgtcggcgttgcctgcatgattgaaataccgtatgagtgaatcatgttcgcaagcgcccgcggttcctgaatcgtctctttacgtgcgatgacgcaccccgccccgctgatgagcggaaggaagagctcaagtccggaaatatcaaacgccgcagtcgtaacggcaagcaggcggtcttgtgcgccgagcgggaacatttcccgcatggataagaggaaattgcttacgctttttaatgtcacgactacgcctttcggtttgcccgttgaacccgatgtatatatgacataagcggggtgcaaaggcgaacattccgcctgatcggaacagtcagcattttgagcggcaacggtttttaccgtatccgggtcatcgagaatgatcctttttgcatcactgtcttccggcatgcggccggataattccatcgttgtaatcaggcatgcagggtgtgcatctttgagcatgtatgtgatccgctcagaaggaaaatcaggatcaagcggcaggtatgcggctcccgttttcaaaacggccagcatgctcacggccaactcctgtgaccgcggaagcagcaaagcggcaaattgttccggtccgagccccttttcctttagcatgccggcaagctggttcgcgcgcttgttcaattcggcatagctgagctcttcgttttcggtgatgattgccggccggtccggtgtttttacggcctgttcgtaaaacagctccggcagacttttctgcttctcggccttgcgcgtgtcattccagctttccagtacgcagagacgttcactttcaggcagaaggttgagtgtgccgattttttgtgtctggtctttcacagcggattccagcagaagcaggaatcgtttttgatggttttcaatatcttcggcgctgtacacttccggattcgcatcaaagtccacacgcattccgcttccgtccgctctgtcgtaaacgttaattgacaaatcatcaacgggcccggctgataagttatggacggtgcctggcgctcctgcgaaatcaagagcgtagtcaaacggcatcacattgacttgcgggccgaacagcctgcggttttctccgagcaatttaagatcgcggcgcatgtcttcatggcggtatttctgatggcgccggatgtttcggatttcttttgccacttggctgacggcctcatgaaaattcatatccgggcggagagaaagccgtaaaggcagaagattcatgaccatactcggaatattcagtgaaatcgagccgatccgtcccatcatcggtaaaccgagcacgatatcccctgcgtttgtcatccggtggacatataccgccgctgcagctgtgacggcttcatgccagttcggaattgcttttacatgctgcaaagccgtttcagaaagataagccgtgcttctccgaaagcttgttgacgttctcggcgctctttctgccaaactgacgacatcaggttcatccgcaaatttctccatccaaaattcccgatctttcaggaattgatcagacgcgcggtattcttgatcttcttttaccagttcctccaaagagccgaaggagcgcccgttatccggacgtccttcccgtattgcggtgtatatttgcgccgtacgccgtgccagcagtgaaaaaccgtagccgtctatcgcaatgtggtgaatgcgctgataccagaaaaagcgttccggtcccgcctgaaataaaatgtcgcggaacaaaggcccggccgccatatcaacgggctcagccaaatctgtctgcatgagtctgagtgcggcctgcttcggatcagcttctgaactcacatctatgacatcgatcgcagcttcaaatggaggattgatgatctgcttcggcccgtctgctccctcttcgaagcgggcgtgtaatgacacggcttccgtcagcacacgttcgagagctgttttaaatatgttcacatcgatcgcgccgtttatctcaacatactcgcctgtattgtaaatcgcattatcaggatcaagctgctgcgcaaaccagataccggcctgtgcgcctgtcagaggcagctgttgtgtatcatgcattctattctctccctttataaataatctgcgttcggcaagactttttgagatcgggaagaaagaagtctccaccactcttcaagcgtcgggttctccgccagttcaacaaacgtcacttcagctccgtcacggcgccattgttcgacaaggctcatgattctgacggaatcaaggcctctgtccagcaggtcttcatgatccggaatatcagacggtgattcttgaagaatcgccgcaatttgttcccgcacccggtcttttgtcaatacggcggaagtcttcccttctccttcagaaaccggcgcgccgcccagcagctccagcacttcgtttgtcaaagccgtgtaagcgcagcgctgagacgcatattcgatggccatcttatgtttttctgaagaaaaatcagcaacggcgtctccgataaagaagctttggatatcatccataaatgcttcacaggctgtgacgagacagccgatgtgtgcataaattcccgtaatcatgagctggtctctgccgctttcacgcatgatgtcaaggagattcgtccgtttaaacgcgctgtatctccactttgtgaggacaatgtcctgatcatccggggcaagctccggaatgaccttttcttcataaggcccgcttttcagccccggtccccaaaaatccgtcagcagcgcgcggtccgccgggtcttggctgcccggctgcgcggtgtacaccaccggaatgccgagcgctttgcattgctcttttattttcttgatattctgagccgcctccgtgatcggagccttccctttctcaaaagcatcgacgaaataattctgcatgtcatggatcagaagcaccgcgcgtttcgggttcagcgtccacgatactttattttcaggcatatctgacgctgtcggcagcgcatatgcgggaattgacggtatagccaatgtaaacacttccttttttaagattgtttgatttcagcaggcttcaatttttgggcgatcgtttcgcgaaggtcctttttgctgaccttgccgacgccggttttcgggaaagaagcgataaattcaacccggtcgggaattttatatgccgccagcccgcgctcccgtaaaaacgctttcagctctcccggtttcggcgcttctcctttcggaatgacgaacacacaggaccgctctccgagaaaatcatccggcattgaaaccatggccgcatcatgaacggcaggatgggccagaaggtgattttccacctcttcagcggcaatcttttcgccgccccgattgatttgatctttcgcacgtccttcaacgatgatatagccgtccgccgtcagtttgacgatatcgccggtctgataaaatccgtcggctgtgaatgatctttcattatgttcaggcgctttataatacccgcgaatcgtgtaagggccgcgtgtaaacaaatgtcccgcttctccgggggcgacatcccgcccgtcatcgtctaaaacccttacctcatcaaaaggtgacatcggtctgccttgcgtattgacaatgatctcttcaggatcatccagtctcgtataattcaccaatccttccgccattccgaaaacctgctgaagggtgcatccgaaagcgctctttacgcggcgggccgcctcagcactgaatttggcgcctcccacctgcagcacttgaaggcttgataaatcatcacttcgcgaaccggatgcgtccatccacaccatcgcaagcggcgggacgagcgctgtaatcgtgacacgttctttttcaattaacgggaagcagtcatccggactcggcgtcggtgacagaacaacacggcctccggcatataaagttcccagcacacccggcgagctgagcggataattatgcgctgtcggcagagcggccaaataaacgctgtgatgatccaagccgcatatttccgcgctgaggcgcaaactgtatatgtaatcgtcgtgtgttcgcggaatcagcttggacagccccgtactgcctcctgaaagctgtaaaaaagcgacttccgccgggcttacctcttccagctgaacaggctctctatgcaggctgctcagttcctgaaactcttcagcttcgccggccacaatgacatgcgccaaatccggaagtttgtctttcacctgtctggcaagcgccctgtaatcaaaacctgaatgcgtatcaggaatgatgtatgctttcgcctctgcaaactcgcagaaatacgtaatctcactgcttctatgagaaggcagcgcgaaaacgggcagtgctccgagtcggaacagcgcgaaaatcacttcaaaaaactcagcgatattcggcagctgaacgacaacgcggtcttccttttgaattccgagcttatgcagccccgccgctaaacgatcggccctttcatctaattctttgtaggtccaatgtacatctttacacgtcacggcagtttgatttccgtataaagccgcgcgctctttcagcattcctccgaacgtctcacccttccagcagccgtcttttcggtatttttcagcccattcttccggccatggcgtaaatccagtcagcacgatccgttccctccttttttacaactcatcttggtaaagccccatcgcccggagcatggtgcggaatttcgccgatgtctcgtccagttcatcctgcggctttgatccggcgacaatcccggcacccgcaaagagccggagagaccttgtttccgcttcggcgcagcgaagtgcgataatccattctccgtcaccttcagcatcacaccagcccgccattcccgtgtagaaattgcggtcaaacggctctatatcctgaatcgcttctctcgccgcatccgtcggcgttccgcatacagcgggcgtcggatgaagagcgatggccagctcaagcgatgtcgttgacggatcactaagctctccctttacctcggtggacaggtgccacatcgcctcagttttaatgagtgacggtttttccggcacatcaagcacacggcagaacggttttagggcggcggccacggcggccacgactacggcatgttcatgcagatcttttgctgattgcagcagttcttccgctcttctctgatcctcggcgggatctgtgctgcgaggtctggaacctgccagcggattggacagaatcgatgttccgtttttggacagcagcagttcaggacttgcgccgaaaagcgtttttcttgtttctgacgttcccgtcacatccgaagcgaatgtatagccgcgcgggttgtgctgcgccaaatgcttgacggcctgaggaatgtcgatatccttttcagcggtcagatgaagcgtccttgacagcacgattttgctgagcgggccgtccgtaatgttgaatacgccttgttccacaccgctcataaagccctcaggctccggaacgggacggatgtcatatgtattggattgcggcttttctgcggaagattccgcaaacgaaagcgggcctgccgtatggacattcttcggtacaaaaagccgggaagcttttctgccgtcaaaaggaatggcgccggccgcaatcggatgtttgatgccggcttgctttgcctcaagaagcgtctgtcttacgcgttcaggcagtgaatccagctgattctccgcgtctgcatccggcacttttgcaaacacaccttctgcaaggagcgtccttttcggggaagctaaaaagaacgctccgggcttgtaagcgtccagcacctcttttgcagacacttccgtcaatacatgttgatttgtcatgtttgtccctccttctcgttaaatcaaacgcctaaagtagcgccgccatccacgcataaatcatgcatcgtgatatggcttgcctgttcagaggccagaaacaaaacggcatttgcaatatcagaaggctttgccagcttttgaagcggaattcccgttttatatgtatcaagcgaacctctgataacgtcctgtgctccgttttcatcccgccacagcgcccgctgcatgtcggtttccgttgaacccggagatacgatgttgcagcggatatgatgggccgcaagctccagtccgaggcatttcgtaaacatggcggcagccgcttttgacgccgcataagccgccatggaagcacgcggaacgccggctgcattcgaaccgaccgtaacgatggcgcctttttgacgctcaatcatgtaccggcttacagcccgcgatacatgaaatacgccggtcgtattaacagaaaatgtttgatcccaatcttcatcactaagggattgcaccggacccggccgcagcacgcccgcaacgttcgccaatatttcaataggccccatgtcacgttcaacggcagcgatgatatcattgacagccgcactgtcagatacatctgcggcaaacccctgcgcctgcacgcctttttgccgaagtctgtcagttagcccgggaagcaggtcttcatttgtatctatagctgccacatttacgccttgttcagcaagggcaagcgctgttgcttctccgatgccttgagcggcgccggtgacaacggccgttttccctttcattcccaatgcgtccatattatcattccctttctatattgataatgattatcattatcaattatgattcaagacaatcatatccaaatcaaaacacgcagtcaattagaaaattagaatcagccgcatttagttcgaagggcctgttttttctcatgtgggagaatacggggtatgcggccctcccggattcaggcagaaacgcagggctctgctgattaaaacgggcaggacagaaatatggccctctccttcaaactcgctgtattcagcacggactccatcatcttcaaatccggataataaagagtacagcgcctctgcgtgctgcgggattctgcttttatgtgttttttcaatttctcccgcagccagcaatacactgacttgaagattttccgcagagagccggtctgacaaacgttctgcgttttcctgaataaaacgcttgttccaatgaattgacggacttcccgcaacataggtctggaacatgtccggcctcgtcaaaagcacttgcagcacaaaaagaccgcccagcgaatggccgaaaatcgtctgcctgtctctgtcgatcggataatcccgctccatcgcgggctttacttcttcttctataaactccagaaacgcttccgcccctccctgttcgggccatgccgcgccgcgcggatgcaccggcagttctgattcagaaagcggcatcgtaaaatcactgtgccgttcggcggaaaacggctgatctgtcgggtagccgattccgacaatcaccgccggaacaacgcctgttttttcaggccgccggctttgcacccgcaaagcttcggccattgtaccgaacacggaatttgcatcaagcaggtagatgacggggaagccggaggcaggcggttcttcctgaggaaaagagacaaagatacgatacgtacggcctccttttgagcgcatttctcttacttctgtgcccggaaccgcgtatcggccggccggcgcgaacccccggtttatttgttttccgtccattatgtgttcatcccctttgtggcaattactttatctatcctcattgataatgattttcaatatcaaaagacacctcaaataataggttttttgccaaacaaagtcaatggatttttgatataaaaaaagcaccttattttaataaggtacctaagaactatatagggataggggcttaatcccatgtaaagcgctcattcttccatggatctcccctcatatggtagccgtttttctcccaaaagccggggtggttttcctttgtaaactgaatgccgcgcagccattttgcgcttttccagaaataaagatgggggaaaacgcctctgagcggatagccgtgctctggcgttaacggctcgccgttatgcgcatatgccagcagggatgtttcccgcgtaaaatcagaaagcggcaggttggccgtccagccctcttcagcgtgcagaatgacgaatcccgcttctttgtgcacacccgctttctcagcgatgtctttggcgcgtattccctgccagatattatcaagacgggaccagcccgtgacgcaatgaatatcatttttcacttcggcttccggaaaggctttgatatctttaaagcttaacagcataggacggtcaacaagcccgtacacttgcagattccattttgacatatcttcataataaggaacatttccggcgtgaagcacgggaaacttcgttgtgacattttgatttggcggaatccgttccgactgttttgtttgtttcgttttcccgaaaaacatatggctccctccatttagtaaacctgtattaaatctttgttgacaatcaatcacccttcgattacgctaatctggtacaagtgtaagggggaaaaacaaatgacacaacgcaaccttcgcgcgggcgatatggcgctgatcggcatgtttgccgccctgatggccgtcggcgccaacattacatcaatggctccttttttgcaagttgcgggaattccgttatcgctgcagcctttcttttgtctgttagccgcgatgcttctcggcgccagacgggcagccattgcaatgacggtatacgcattggccggactcgcgggggcgcctgttttcgctcaattctcagcaggctttgcgccgtttatcggaaagagcggcgggtttattctcgcttacatcccggcggcatttgcagccggatggctgctggaaaaaacaaaaaaacccggccgcctgcattatgcatgggcctctttgatcggtaccgccgtcatttatatcattggcacgacctatacgtatattgcgctgaaattatggcttcatgctccgatcagctacggaatggcctggttttacatgatatggtttttcataaaagatatcgttttagcactgttattggcatcaatcgcgcctgccgtatacaggtctattcataaagcgacggggttcagcagaaatccggcgtaagatgttctcagcatacaaaaaggctcccctttccgggagcctttttttacaggacaagcgcggcaatccagccgaatatcacaagcggaatgttatagaaaataaatgtcggtacgcacgtatcccaaatgtggtggtgctgtccgtcggcgctgaggcctgacgtcggcccgagcgtactgtcacttgcaggagaacccgcatcaccgaccgcggcggccgctccgattacggcgatcgtcgccatcgggctgaatccgagctgagcgcacagcgggacaaatatggtcgtaatgacgggtacggttgcaaatgatgatccgattcccatcgtgattaataaaccgaccaccagcatcaggagcgcgcctaatgattgactgtgaccgataaagcctgttgatgctttgaccaaggaagccacatcgcccgttttgttcaatacatttgaaaaaccggccgcaacaagcatgacaaacccgataaaagccatcagaatcatgccgtccgtgatcagcttatccgcttcattgcgcttcatgactccgctgataaacagcgtaaacaagccggcaagcgcgcccatgatcataccttccactccgagcacttgtgacagatagagctgaacggcaagcgacacggcaatggagatcagggcgatggcaatgctttttttcgtataaggagaagacgacagtccggcaatctccttcgtctcatatttcttcggtttccggaagacgatgacggataaaattaaaccgactaccatcccggccgtcgggatgattaaagcatacggaatatcactgagcggcacctttaaaccggctgacgccatattatctctcagcatcccctggaaaatctgtccgaatccgacaggcagaacgatatacggcgcagtcagtccgaatgtcatcacacacgcgatcagcctgcggtctatttcaagttcgttaaatatttttaaaagcggcggaatcaatacaggaataaacgcaatgtgaacgggcaccacgttttgcgagaaacaggatatgattaaaataaccagtacgattaacacttttgacagtgcttttttccgcgaatcttccttttttccgattagtttgacagacgcttccaccattgcatcgggaagccccgtcttcgtcagcgccgcggcaaatgctccgagcagcgcgtagctgaccgcgacggtggcatttccgccgagaccgtccgtaaaagccttcaccgtctctccgaggcctaagccgccggtcagcccgccggcaagcgcgccgatcattaaagctataataatattgacacgcagcaggcttaagacgagcataagcaatactgcgacaacaacagcattcattgatgagtccctccaaaaatcctttagtttgctaatgtagtagataattaaagttaacatacattctgcgctttagtcaactaaagattttggaaatcaaaaaacccgctgcatcaaggcagcgggatgctgttatctttcgggcgtaaaccgctcagtcaaaacagccaacgtccttgccatgacgcctgttgcgccggcagggccgaagcatgtcgctttattcgccgtcgcggttcccgcaatatcgagatgaacccacggcgtgttttccgcgaattcaccaaggaatgcccccgccataatcgcgtggccttctcttcccggagaattgttcaaatcagccatctgactgtttctcacccgttttttatccttttctgtaatcggaagctgccagatcggctcgccggattctttcgccgattccgccacctgttcataaaacgcggcgtgattggtcatggcgcccgtcatttcgttacctaaggcgacaatgacaccgcccgttaacgttgcgacgtctacaaggacagaggctccgtgctgcttggcgtatgtgatgccgtcggcaagcacgagacgcccttccgcatcggtgttcaggatctcaatggtttttccgctgagcgaaacgatgacgtcatccggcttcatagcatcggacgaaatcatgttgtccgtagacggtatgacggcgagcacgttttgttcaggccggagttcgccgataatttccattgcgcccaataccgaggcggcccctcccatatcgcttttcatgccgacgatgccggttttcggcttaattgaatatccgcccgtatcaaaggtaattcctttaccgaccaggccgatgacgtcttcccactgatctttgccctgatacttcagaacgatcattttcggcggttcggatgagcctttgttaacggcaagcagcccgcccatgccgagctcttccatttcatctttttctaaaatttcacactcgaaatcgtattttgccgcaagctcagcggcatatgacgccaaatcagtggccgtcagcatattacccggcatattcacaagcgtgcgggctgaattcgtcccttggccgtatgccgcgccgacgttcaggccggcctgcacttccctcaggtcttcttcggtcacggcgcagactgatttcagttcctgatccggctcattcgatttatgtttataatcctgcacctcataaaccgcaagcagacagctttccgaaagcgcatgagcggcatcggcggcaggcacttccccggagacgaatgtatcgagcaacacggatacttcctgttttttatcttgatgaatctgctgaaatactcgtgcaaagcattctttcgtatcttcaaacgaataatccgcttctcttcccaggccgataaaataaatacgtttcataccggtcgcagccggagggtatacttttgatacacgattgcgtttggcggacacatcaccatcctttaacagctgggtcagatgaccgtctaatttatcatccaattccttcgtaaatccgttcagcgtgcttttttgaaaaagaccgatgaccagtgtttcgggatgccgcagttgatcagatgcataaaacatgagtacacactccttatgtgggtatttgttatgtaaagtggtataatgaaaaaacatttttcattgattttattttaccaaactaagggcgttttctgcagtttttcgatacgatcggaatcagcagatacagaaaggatgtcgcatatggatgtacttatgaattttcctttactggcgagttttgccgccattatttttgcccaagttgtaaaagtgcctattcaatttatcgtatccaaaaaacttgactggtctcttgtgacgagcaccggcggcatgccgagctcccattccgccgccgtcaccgcgctgtcaaccggaatcgctttggaacagggactggactcgcccctgtttgcagtcgccgcgattttcgccgtcattacgatgttcgatgctacaggtgtcaggcggcatgcgggtgaacaggcgacagtcattaataaactggtcatcgactttaatcggtttgtcagcgaagcgaaggactttcagaaagcggaagagaaagaaaaacagaagaaactgaaagaactgctcggccatcagccgattgaagtgttcttcggcggcgtcaccggtattgtgctgacattgattttagattatttctttatgtaaaaacgcttcagcggatgctgaagcgtttttattcttttaccgttttgtattgatttctgaacacttgcagcgactttgtttcgttcagctttacaagttcgtcctcggtcactgtgccgttcccttttttaataatgtagacctcaagtgtttttttgccccaattgttatagacgtccttgacggtgtcaaagtagaggtcaaggcggctgcctttaatttttgagccggtatcggcgacaaccccgtaaccgtaattcggtataaacagaatcgtcccgatcgggaaaacagacggatcggccgcaacagttgaatataaatcgcgtttgaccttcacacctgaatatgtaattccgtactgcggatgacccggagattttccggtagattccgctccggcggtataaccggtggccgtcactttttgtgacggatagcgttcccagtcaaaagcttcttccagcggctttaccctgcctgatgccttcttttccggctgattctgtaaggattgaaacggagtgccgatgtttttcaaaacggcgccgcgatgttccgtcatccaatttgtcagatcctttgcttcaacaccggttatagaaaagtatgtcgcatggcatgcgcccaaaaagagcacgatcatgaatacgcgtctgattatcgtcaatctgaaatcactctcctccgagtcattgttcccaactcggtgaggtgctatacaaaaagcgccgtgacacaaaaaaagctttcttgaataagaaagcggtttaaaacatttgatatcctctttttctgagcgcctttatggcaatgcctgacatgatggctcccgccagtccgcccgccaaaatcacgacatccgcaaccgctaatgacatgatgcgctgaaacaggctttgaaaggattcccccggcgcctgcacgtaactgatcatctttttattgctgataatgaaaaggcatacaatcggatagacaacagccataatccacgacattctaagcagcatgttcaacagaaagcctatgccgaaaaacagtacaaaaaatagtacgattgagatcaggacaaccggcaaactaatcacaaacatccaccccctacagcactttcagtgtacctcgggggcggtaaaaaagtcaacgtctggaaaaatcagcgtctctctttgccgcttccctggcaggagggacatgtttcggagccgccaagaagcaattgaaaataccctttacctgagcagaacggacacgccgccgtgctttttgctgtcgttttcatgcggatcaccctttttcttaattttctgataatatatcatatttacttgtcaagcaccaagtcagaatatgtaacataacaactcatgtaagcggaaacattcttttttttcttttacatgctttttatagcgctcttttttaaaagaagagaaaacccgcggctgcgggttttcagaagaatttaaacttcccttttttcagcgtcaggcccagcccgccgatcataaagagcgagcggttatcaatgacctttttcataaaggacgccggcgtgcctttaagcttcctgccgtatacgactccgacggcgttatgctcaccgagggaggcgaccgttcctttaatgtcaggcttgaactcttcaagctggcctccttttatcaaaccgcccagatttttggcgaccgtttctccttgctgcatcgcgatctgagcagtcggcgggtacggccgttccgtctcttcattgataaagagcgagctgtcgccgagaataaaaacgtcatcatgtcccggcgcccgaagatcagggttgactttgacacggccgcgcatattttcaaaacccgcttcctccacgatcggatgtccgcgcacacccgcggcccagacaacggtctgcgatttgatttcttccggctcttcatctttcttgccgactgtgacaccgtctgcgcggcattcttgaaccgcggtgccgattttaaattcaacgcctttgctctcaaggtattgaacggcgtaatcgacaagctccggatcaaatcccggcaaaaccgtcggggcggcctcgacacagacgatccggacgagactttcatctatatcataatatctgcataactccggcttgcggttcgcaagttcaccgagaaattcaattcccgtaaagcccgctccgccgacaacgatggttaagcggtcagggcgtttttcggcctccgtattgtatgtcgcaaattggagctcaatatggtctttcagctggcgcgacgtattaatattcgcgatcggaaaagcgaattcttttaaacctttaatcccgaatgtttcagggacggcgccaagcccgatgacgagataatcataagggatgtccccttgtgaaagcgtcacctttttattttgcacatctatcgcttttacggtatcctgcacaaatttgacccgtgattcattgattacatcttttatttgatatctgcagcggtcatgatgcagcgttcctgcgctcgcttcatgcatccatgtcgtttcataatgataattgtgtttattgaccaaagtaatgtcggcgtcatttgccccgatatgcttcggaagccttgttactgtcattaatccaccataacctgcacctaaaaccacgattttgggtttattcaatgccatcacatccaccttcttttttttgctgttagacgcataatcaaatcaacatttgtattagcttcagcttattggcgggattttatgaaatgaaatataaaattttttagaaaaccgcacatgtctgcatatcaccatactatccggaagaatcggaaaacattcaggaaaaaacagattggaatttgtccccatcttagcggcggccgcaatttttttcaagaatgaagcggccgggcggttttcggcactcgtcatcctttcaaattgtatgttataattaataacaattttcaattaggaggcaatttggtatgcaagaggattcaaaggtttatgatattacggtcatcggcggcggtccggtcggcctgtttaccgctttttacgggggaatgagacaggcgagcgtcaaaatcatcgagagcctgcctcagcttggcggccagctcagcgcgctgtaccctgaaaaatatatttatgatgtagccggattcccgaaaatccgcgcccaggaacttgtgaacaacttaaaagagcaaatggcaaagttcgatcagaccatctgcttagagcaggccgttgaatctgttgaaaaacaggcggacggtgtgtttaagcttgtcacgaattcagaaacgcattattcaaaaacggtcattatcaccgcgggaaacggcgcatttaagccgagaaagcttgagctggaatcagcggaacaatatgaaggcaaaaacctgcactacttcattgacgacctcaatcaattcgcaggcagacgcgttgccgttctgggcggcggcgattccgctgttgactgggcgctcatgcttgagccgattgccaaagaagtcagcatcatccaccgccgtgataaattccgcgcgcatgagcacagtgtcgaaaacctgcataattctaaagtcaacgtgctgacaccgtttgttcccgctgaacttgtcggtgaagaccggatcgaacagctcgttctcgaagaagtgaaaggcgaccgtaaagaaatcattgaaattgatgacctgatcgtaaactacggctttgtttcttctctcggcccgattaaaaactggggtcttgatatcgagaaaaattccatcgtcgtcaaaagcacgatggaaacgaatattgaaggcttctttgccgccggagatatctgcacatatgaaggcaaagtcaagctgatcgccagcggtttcggcgaagctccgacagccgtgaacaacgcgaaggcttacatggacccgaaagcgcgcgtccagccactgcattctacaagcatgtttgaaaaataatataaaaaagagtctgtgtcataccggcacagactcttttttatttaaacatccaaatataattcatgacggttccgacaacgagcgcaatgacaagcgccgacacgacccaaatcgtgcctaaaataatccggtcctgaattttctgggctttcgggctgtgcccgggctgtttttgttccataccggcccctcccttcttctgcaaatctatctatcgtaacaaatgtcttacaacaaccaatactactatgataaccaaactgcaaatggatgacaagctgaccgcatatgaggcagcatgaaatcatttgacattcctgacaaaacaaagtacattataaaaagacgaacattttaattttatttaaatatattattcgcttttaggggtgttatatatggaaaatgtatttgattacgaagatattcagctgattcctgcaaaatgcattgttgaaagccgatctgaatgtgatacatcagttacgttgggcggacacacgtttaaacttccggtcgtaccggccaacatgcagacgattatagatgaaaacatcgcggcctggctcgcggaaaacgggtatttttatatcatgcaccgcttcgagccggaaaaacgtctggcttttgtccgggatatgaaagcgcgcggactgatttcttccatcagtgtcggcgtgaaggaaaatgactatgaattcatccgggagctgaaagaacaggagctggtgccggattatattaccattgatatcgcgcacggccattccaatgccgtgatcagcatgattgaatttattaaagaacatgtcccggaaagctttgtcattgcagggaatgtcgggacgcctgaagccgtaagggagctggaacgcgcgggcgctgacgcgacaaaagtgggaatcggccccgggaaagtctgcatcacaaaaattaaaaccggcttcggaaccggcgggtggcaattagccgcgcttcgctggtgcgcaaaagcggcgagcaaaccgatcattgctgacggcggcatccgcacgcacggcgatatcgcgaaatccatccgattcggcgcgtctatggtcatgatcggatcattattcgccggccacgaagaatcaccgggacaaacgatcgaaatcgacggaaagctgtacaaagaatatttcggctccgcttctgaatttcaaaaaggcgaaaagaaaaacgtcgagggcaaaaaaatgcatgtcgaacataaagggtctttgcaggacacgctggttgaaatggagcaggatctgcaatcttccatctcttacgccggcggcaatacactcgaagccatccgtaatgtcgactatgtaatcgtaaaaaactctattttcaacggcgacagattttaacatgcagcagagccgctcgaagataaaaaaaatgacattcatattgaatgtcatttttttattaaataccgaaataaagagccgcactggctaacagattaatcacaaaaataaacaaaaagatgtaacgaatgaatttattttgcaccggagcaaatataaagagatatagtcctgccaccccaaaagtaagaacaggaaacagccactcaaaggataaagaaatgatataaccgataatcataacaatcggcacaccgattaatgataatttacttctcatatgatttctgccccttttacttaaaaattggtgtgatgtaagcttcaataacggcagcggcgatcagcagacaaataataagcagcaccaatattccaatatgcctgaacattgaaaccattatctttttttccttagaaaaacacagcctgatgaccaattcaacgcccttaaaaccaatggcgccacttaataataacgcaggaacttcaaatataccatgaggaattagcagtaaaaaaatctgataaaaaggaaccccgctatgcagattttctataatagagccgcttaaaataaacccgttggtgaataaataaaagattgaggtcaacccaaaggtaaaaaaacccgcggctaaaaacagacaagcgattgcattgtttttcagcagttcaaccgcgcctgacgagccgttgtaagacgctgatgaaacaaagtgatcggaaaaaaacgcagcgatcacaccgcctgaaaaaaacagcactgacgcggttaacggaatggcggacgttctgattgccggcaacatgcggttcatcatgtatagatacgctcagccaattcttcaatctcttctaatgaatgctcggatgactgatactccgccgcaaaaacgccttcatgtataataccgatcgtatcgcacagcgaatgcgccagctccagcaggtgagtcgataacaggactgtatttccctgcttgacgtactcctttaataacgtccgtatcgttttaccgctgattaaatcaatgcccgtcagcggctcgtcaagaattaatatctttggctgatgaatgagcgctgccgcaattgataatttttgtttcattccatgtgaataagttttaatcagctgatttccgtcttgagaaagcttcagcgtctccaacatattctttatataatcatttgtccgctgagacggaacttgaaacatttccgctgtaaaacgcaagtattcgactcccgttaagtaatcatataaaaaagcatggtcgggcacaaaaccgatatcagccgatatttgccccccctcttctgaatccagttccttgccgtcaatcatgacgcggcctgaagtcggtttaagcaggcccgaaatgattttcaaagtcgttgttttcccgactccattagtccccagcaaagcatagattgagccttttttcacctcaaacgaaatatctttcaatacctgtttttcactatagtttttttgtatattcactaatttaatcattgttcgcaaacctttccgccatattgattctgcgaagaaacagaaacatgactccatagtttaatagtgtgaacaggacaaaaatacctgatgcagaatgaataagcatcgtttcaagttccggctttttatagataaaataggacgtgatcgcagcgatttgaagcgacacaatgaaaatgaaagaactgtataagttgttatacgtctttgctttccccgcttctccaatttcgtacagatgctcccagtttttcttaggatacagggcggtgcttgaaatctggacgagactgtataaaaaacccgaacataaaaacacaataaacaggtaaatcgtcagcgccgcggaagacggaaaaaacaccgtaatcaaaatggtgatgatgaacgaatagataagagcggcgagattataaatacatactttcggaaacaccagctgccacgcatgtttgatattccggtgaaacagatgctgattttttatttccccgtcaactgataatactgttttgagcgcatctccgacgagctgatacgaaaagttcgcaatgataaccgccgcagacacgatggcggctgccgaatacccgataaagtgatgcgatagaagcggaatacaaaaacctaaaaacagcatgaacaaatacagcatactgccgaagttcctgataaaaaacccgtcaattctcgataaaaacagcagatccttttgaaaaacggcatgaaatattttgttatttctatataatttcagctttggcgcaaaatcagcgtttgtcaaaaacatataaggaataaggtccattttcttcagcgtggccgaccacagtttaaacatccccgccgttaaaaggacggcggccgcaaacaccgcagcgaaaacgagcacggaatgtgagcggaatgctaaccatacatacggcgtattcatgaggatgttccggaaagccggtgactccgtaaagcttgaaatatcctttgcggtatactccccaaacacgagaagataaacggcatacccgactgcaagcggaaccagcaggctgacgctgaataaaatgcctttcaggattttcaagtaaaacaatttgctccatatatttgtaagaagataaacaacataagaaaacagcatagataaaaataaattgagaagaaaataaacgaagcccaagaaaaatacgatgatcgccgcagacccggtcatgcctgcgcttgataaaaacaaaaagaccggaaaaacaaaaagataccatacgaaaatggtttttttgatcgcctggccggcaaaaacagaaaacagctgtaaaaaacgcaccttttttaattgatgaatgaccttgcgcgtatccagcagaaaggcattgtgatgttctttaaagaagccggcagcccaaaaaagctgctcaagtgaaacggcgattaaaacaaattgcccccatgcgctgaggggcagctgaatcagttttgtcccgaatacaacaccgcatcccaggaaaacgagatataaacataacagagaaataataatggcagacagcagtttgctgttgagttgaggaatgccccaatcttcctttctttttcgaaacgatgacagggtattatatttgataagagccgcaatttgtttgactatcatactttcaatccttacatatgtatttgggagagaggctctttttgcagcttgtacaaaaagagcaattatttattggtcgattttaccaagcagctgcgtattttttgccgtatttcttaatcattgtttttgctgttgcaacgattgcataagaaatcgcgcctgcgcctgtaacgataccgatgagagaaatgatagaagcaattgttgatgccgcatcaataatatcaattgcttttttagctgctgctgtagagatgcccagagtcgaagctaattcagcattggctgagaatgcatgagccgccgccacgtttaattcagttcccgttaataatagtgcataaaccaatgttgctgcagcaagagccacgccaaacaaaatgaaagactttttattagattttactaagttcatcataacatctccctactctgtttttttaatttataataaaattcagcttaattgactctctcccgagctaaattttatccgccataaaataattaaagaaaatagtaaagagttttaataaaacaaaacatccagtcaaaatgattctcttgcctttactgagatcggtcagttttcctgcggcagcataaagagccgcaattgatatgagcagaaatggatccagcagctgcagactcaagctggtgccgccggcagaatatataagcgaggaatcagccgttaagtagttaacaactgaaagaatcaacattttaaatgccgagattaaagaagtcagtgtatatagaagcaaatatatttttttcggtttttttgtaccgagaataaaagcggcaacgaataatagaaatccgcctatcagaatttccacaaaagttgtgaagatcataaacccttgcagaaacatgacaatcgtacgaacacttttctccccgatatcgtaggtactttctccgacggaagaataatacgactgcagaactttatcggaaatactgaattggaagagtaatgaacagatcaaaatgatgaaaaaagaacttaaaaatatttttttattgctcaattgacctatcatattatcatccttttcttacaaaataaattaactattctatacttttacaatttagtttattcctatcaaaaaatcaatatcctttcgaaaaatatgactttagaacgtgttgactaagagcacatcttccagattttttgattctatataccctttatttttttccgaatttgcaaatagtatgatttgaaccgttgatttgaggatttttgtgaaggccgtcactcctaaacctattgaaaatctgcccatttccttttgtgacatatgtctgaattcatcacattttttttattgacttaaaacatggtttaagtcgtatcatcacccagtgacaaggaaaaaatactgttggaggtctttcgaagacatgttgttcaattcgtgaagcagcagcaaagtgtaatatgacagaatcaacgttacgttattatgaaaaaaagggactgctgccgctgattgaacgtgatgaagccagccggcggttattttcagcagatcaaatgccgctccttgatatcgtgatttgtttaaaaaatacccgcatgaccatcaaaggctttaagcaatatattgattgggtaattgaaggagagagtcctattaaactccggcttgacatgatgaggagacacaagcggtcagtactggatgaaatgtcgtcaatgacaaaggcttatatcaaaagctctgttcaagagacgtaagtttgttgaagtaaaaacaatcggaaaagaggagttaatatgaaactgacgggaaatacaatactgattacaggcggaaatgccggaataggattggctttcgcagaacggtttttaaaagcgggaaataaagtcatcgtgaccggacggcgtaagcacgctcttcaaaaagcaaaggaaacattcccggatcttattacctatgtcagtgatttgagcattccatctgaacgtgtatcactgtttgattgggtgaaagaaaattatccggaagtgaatgtgttagtaaacaacgcggggattcaacatcgttttcatgtgctgaaagcggatgcgaaggacaattgggactattttaataaagaaatcacaacgaacattgaagctcccttccacctgtctatgctgttcgctccgttttttgccggaaaagaagatgcggctgtcattaacgtctcttcgggattggcttttacaccgcttgctattgcaccgatctattcagcaacgaaagcggcgcttcattcatttacaatgagtctgagacatcagctttctgattcatctgtagaagtgattgaagttgcgcctccggcggtaaatacagatttaggcggagcagggctgcatactcaaggagaaccgctggatgaattcgctgatgggatttttaaaggactgaaagagggcaaactagaaatcggttacggttcttcagcggaacggctgcgcatgtcacgggataaagccgatgaacatacggcaaatatgtacaatgcgatgaaacatacaattgaataacctctttgaaaaagcaaaacccgcttctgttgagcgggttttgcttttattaaacagataaacgccttttttaacaatggtgcaagcgccatcgaaaagaaaggcgtcctattttttcatcctgagaatggcgggctgacccttagcactcttccggcgtaccggcgtttttggccgtgcggaaagaagatccgcagccgcaggaagcgatggcattcgggttgtcaatggtgaaaccgccgcccatcatggactgtttgaagtcaatgatcgtgccggtcataatatcaaggctttcgctgtcaaccaaaacggtgatcccgtgctgttcaaacatgctgtctttttcgcctttttcgtgctcaaatcccattccgtaagacaggccgctgcagccgccgccttttacgcccacacggagaaacgcgttttcttcttcatgctctttcatcatatcttttatatgcaaagccgctgcttcagtaatagttactggaacactcataagtagacctccttttttaaaaacggatgctgatatctattataaaccttgaggagcgtatttctcaaacgagctgtttacaaataatagacgccgctgcatacggtttcggcgggtcccgtcatcagcacgtgcccgttgtcctgccaattaatcacaagatcgccccccgctaaatgaacggtgatatcccggtttcgttcggaaacaccgttcaatacggatgcaacagccgccgcacaggcgcccgttccgcaagcctgtgtaatgccggagccgcgttcccatacgcggaaatgaagttcatcggcgctgacggtttccacaaattcgacattgacgccttccggaaatctcgggtctttttcaatgacgggaccgagcgttgtaagaggcgcttgattaatatccgcaaccggaaaaacaatatgggggtttcccattgatacggctgttccggaaagctccgtttctccaaaaacaaaggtttcatcgatcgtccgttcatcttcattgccgagcatcggcagctcttttttggtgaggcgcggttcgcccatatcgacggcgacttcacgcacaatcccgttttcttccgtaatatctgctttcacaaggcctgaaagcgtctcaatgaaaaaggacgtttcttctgtcagcttatgttcgtatgcatactttgccacacagcgaaggccgttgccgcaatttttcccttctgagccgtcattattaaaaatccgcattttgaccggcgctttttctgacggacagatgaggatcattccgtcagagccgatgcccgtgtgaatgctggacactttaacggcaatctcagccagccgttcttccggcagctgttcttcaaattgatttacatatatataactgtttccaagaccgtgcatcttggtaaaacggaatgaattcatatcggcctccaactttttttcttttacttagtataaaagctcttcccctcggacacaatacaaatatcccccgtttttcatacataaaagctccctgcatatgcagggagcttttatcgtttactaaataaacatgccggcaatcgccgcgctgagaaggtttgcgagtgttcccgcaataaccgctcttaatccgaggcgcgcaatgtccgaacggcggcttggggccaaaccgcccagtgtgccgagcataatcgcaatcgaagagaagttggcaaatccgcacagcgcaaagctgataatcgtagacgtttttttagaaaagtccgcaatatgcggaccgaagtttgaataagcgacaaactcattcagcacaagtttctgtccgatatagcttcccgctccgagcgcctcatgccaaggaacgccgattacaaatgcgatcggtgaaaacacgtaaccgagaatggattctaatgtaatatgtttgaaaccgaaccagccgccgattccgccgagaattccgttcactacggcgatgagcgcgacaaacgcaagaagcatggcgccgacattcagagcaatctgaaggcccgtggatgcgccttttgccgctgcatcaatcacattagcggcgccttcgccttcttcgtccatattaaaatcgccttttatcgtctgcgttttttctgtttcaggtattaacatttttccgaacacgagaccggcgggagccgccataaagctggccgccagcaggtattcaatcggaatgcctaacagggcgtaaccgaaaagcgtcgaacccgctacagccgaaaggccgctcgtcataatcgtaaacagctcggaacgggtcaatcccgcaatcagcggtttaatggcaagcggtgattcagactgtccgacaaaaatattcgcagccgccgcaagcgattccgttctgcttgtcccaagaagttttgacagtccgcctccgatgacgcgaaagatgagctgcatgattttcaagtgatacaaaacggcaatcagcgctgagaaaaagataatgaccggcagaacgctcagcgcgaaagccgggctgctgcccacttttaacagcgggccaaaaataaagctgatgccttcgttcgcataatcaatgagaagctgcacacggcttgagaaccataaaaatacggcccggccggcgtcccactttaatacgatgaatccgaaggccatttgtaaacataaacccacaatgacggttcgcaggttaattttgcttttcttctctgataacaaaaaagcaatggctaatatagcaactgccccgagcagcccccaaacgatattcaatgaatccacctctaaaattttatttaaaaaaagtctttattaagataacaatatttatttttgctgtctacaaattttttattttgccaaaacccgggcgcaataaaaaagagaccccgttcggagcctctgattaaaacatcggattttcttctatgaatgtatatatgttgtcaaccaactcagcaggcgtgccccccgtgaccacttcgccgttaaccagggcgaacagggactccatgcattttccgcagtagcttaaacagccgtactcaagcacgtccaagttcggatccttctctaagatctcaagtgcttcctgggaaccgcgcgctaaattgctgacacagaattcaatcatcggattcatgcggtttcacctcacatatgtaccttatcctaacggaatttcctctattcgtcaaagatccggtttcacgctcaatgttatcgtaacatattaattcaggttaaaggttttactattgcgtgttttctggtcaatttgtaggttattttaaaactattattgtggttttagatcaaattcgatataattctagatgttattttacatagttcgttattttgtaacaatattgactaccatatttttcgggcaaaaggggaatcattatgaaaaaattggtcttgatcggcgggggttacggaaacatgcgggtgctgcaccgcttactgccgaaccagcttccgtcagatgtatccatcacgctgattgacagaaacccgtatcactgcttaaaaacagaatattatgcgctcgcagccggcacgatttctgatcatcatatcagggtgtcttttcctgagcatccgaatctggatgttcaatacggtgaggtggcttccatcgacacgaaaaacaaacaggttctgtttcatgaccgcgaaccgatttcttacgatgacgcggtgatcggactgggctgtgaggataagtatcataacgtgcccggcgcgccggaacatacttacagcattcagaccattgatcagtcacgcgaagcctatcaaaagctgaacaacctcggcgccaatgcatctgtcgctatcgtcggagcgggattaagcggcgtggagcttgccagtgaattaagagagagccgtgacgatctgaagattatgttatttgaccggggcgacctgattttatcaagctttccgaaaagactcagcaagtacgttcagaaatggtttgaagaacacggcgtcaccattatcaataatgcgaatattacaaaagtggaagacggcatcgtttataatcatgatgaaggaataccggccgatgccatcgtgtggacggcgggaattcagccgaataaagccgtcagagaactggacgctgaaaaagacccgcaaggccgcatcgttttaacaccgcatcacaatcttccgggcgatgagcatgtttacgtcgtcggtgattgcgcgagcctgccgcatgcgccgagcgcccagctggctgaagcgcaggcggaacaaattgtgcagatcctcctgaaacgctggaacaatgaagagctgccggaaacaatgccgcaatttaagctgaaaggcgtcctcggttcactcggaaaaaaagcgggcttcggtcttgtcaacgaccgtccgctcatcgggcgtgtgccccgtttattaaaatcaggccttttatggatgtacaagcatcataacggctgataagaaaaaagccgctgattgcgatcagcggccatttttaagagcccgccacatagccgcgcttttccatttcttcatatatatcttttaaatgcggattcccttcccccacaatgacatcctccaccagcacgagcggatagaaaaattcatcgttcttgatgcgctccgcaagctcttctgtctccttttgctgaggcggtgcctcaatatcaatataccgcatgttaaaaggctgctccgggtatttccgtttcagcgccgcctccagccattcaaacgtatctttggcgctcggcatattcacgcagcttgcgcaaagcgtttcagcgccgtaaacactgagcgtaaccggctttgtcatgtatatcatcccctttacaccagtatacaaaggacggggcagcttttgtataaaaaacggtttttatgttcaagtttaaatatgctataatggagaaagcagctttgcaaaccaaacattagatttttaccgttactgtgaatataatggttttatgtatatgaaaggagcgaatctcatgactgaggttgaaatgaaagagcaagtacaggaagtattggataaattacgtccgtttctgcttcgtgacggcggtgactgtgagcttgttgatgtagacgaaggcattgtaaagcttcgcctccttggcgcatgcggcagctgcccaagttcaacgattacgctgaaagccggaattgaacgcgcccttcttgaagaagtaccgggtgtcgttgaagtagaacaagtattttaatcataaaaccaggctgcatgacagcctggtttttttatttttacaaatagtcatcaaaccatgaacaaatataacggatgcgtttcatccgctgttcgggatggccgcttctcgacagctcatgcgtagctttcggaaatcggatgaacgacgtcgttttgttcagtttcttcaacgcggtaaagagctgctccgcctgctctatcggacagcggtcatctcgctcaccgtgcaggatcaaaagcggcgtcgaaacgcgggatgcatattttacaggagaacgatcccaaagcttatccgcttcctcaaacaaatcatgtccgagctgccagtcggtaaaaaagaagccgatatcgctgacaccgtggaagctgaaccaatttgaaatggagcgctgcgtgacggctgctttaaaacggcctgtctgtccgacaatccaattcgtcataaaccctccgtagcttccgcccgtcacaccgagacggccgctgtctaaaaacggatacgcctgaacggcttcatccaccgcctgcatgacatcacggtaatctccgcctccgtaatcacccctgacacgattgacaaaatcctgtccgtagccgtggcttcctctcgggttgacatacacgacagcatatccttgtgcggccagcacttggaattcgtgaaaatacgtatggccgtacatcatgtgaggcccgccgtgtatgtatagaatgaggggatatgtttgatcctcttcaaaaacggaaggctttaaaaaccagccgtttaccgtcagcccgtcctttgtttcatattgcagcttttccggcacggatatgatacgctcctctataaaccgatcattgtaaaatgtcaattgcctctcttccccattttcaagtgaaatgctgtaaagctcggaaggctgtgcgggtttggcaatgacagcgatacagcttttctgatcaggatgaaaagcaaaaccgttcacgtactcttcttctaatcggatcggatatacgaggccgtcaatcgagatataataaataccggtgcttccctgctcgctcccgagaacgtaaaagccctgcccgtcgtttgtccataccggccggggcgtcactcctcctatgattgaatccgcaatcagcgcatcgctcaaatgaacatccagcatgtcggtcaggcaggacagccgctcagttttcacgtcgtacagccacgctttctctaaagtcgcattgcgaaattcattctcatggcccagcatcgcgatataagaaccgtccggtgaaaacacgcaggaaccgaaagaaccgcggtgcggcgtaatctgcttcaggcttccgtccgccagattcatcagatagacatcgctcggctttccggcgtcacccggctcgcataaattggcggtaaacgcaagctgcctgccatccggtgaaaaggccgcgccataatgatcagcttcatgatctgtcagctgctgaatctcccccgtttcaagatgaatcagcacaagctgtgtccggcttccgttcagcaggcccttcccgtcacgtttatatgttaatgattgaatctcaaccggctcatactcgtcatgcttctttttttctttctcatcggcgcgctccgctgatgtcagactgacggacacaagcacggatctgccgtcgggcgcccatatcggatctgatacgccccaaggaatatcggcagcctgttccgcctctccgccggcagcgtcgatgatgtacagctgagggatgccgtcctccctgtcagaaacaaaggcgaggcgccgaccgtcaggcgaccaccgcggacttgtatttttatcgtccccgaaagtccacgggtttgagatgccggattctgtgtcatataccataatggctgaggaataggaatcacgcttatgattgactgttgtccggacgtaagcggctcttctgccgtcaggggcatattgcgggtctgtcacggatacgagtgacgcaatgtcctcctcggttatgagttttttcaatcgtatctcctccttttcttttttatttcgcttccctaaataaaaatccttctccagaaaaagaaagcgtccttctctgatgggaagaacgcttttttatcattatacacttttcacctgctctaaaggattccgttcaattacgcttccttctgacgggacggtaagcgccgcaatctcacagtgagggaaatgctcagaaagctgttttctcagctcttctccctttcctttttcaatcaggacaagaatcgtcggtcccgctccgctcagcgccgttccgtaagcgcctttcatttcggccgcgtgttccacctttgaaagctcaggaacaagcatggcgcggtacggctgatggaggatgtcttttctcatcattttcccggcgagcgcccagtcatttgacatgatcgcagcaacgagaaggttgctgacggcgcttgctttaacggcgcgtcggtacggcagctctttcgggagcacgtctcttgcgtccctggtcagaacttcgtaaaacggaatcactgccacaacatcgatatccgcttcggcaacacgcacgatatgtgtttcatcttcttcgtgaaggccgattacaagccctcctgcaagggaagcagcggcattatcagggtgcccctcttcaagactggctaagtgcagcttgtcgctttccgacagctgcaggccgcataactcatccgcaagctcaatggcggcgacgatagcggccgcgctgcttccgagaccccgcgcaagggggatgtcactccaaactttgacatgggcgggcggcagctctttctgatagcggtcagccgtccgtttggcgacttggtagatgaggttgtccgttccttgagggatgcccgcgacagtttcggtttccgccgagaactgccattcatcgtttcggaaaaccgaaagcttcaaatatctgctgagcgccattccgatggaatcaaacccaggtcctaagttggcggtgcttcccggaaccgtaatggaaaacagcatctccgcctcattcatacacgcgccgctccatttaagtattccagaatactgtcctcatctgtcggcagcgtgatcggttttatgtcagatacgtccacagccgtattcggatctttcaggccgtttccggtcaaaactgcgacaaccttgcttccttttggaatttcaccggatttcacctgtttcaaaacgccggcgatggatgcacaggagcccggctcggcaaatacgccttcttcacgggcaatcagctgataagcgtgaaggatttctccatctgtgacttcatcaatttttccggctgattcttccgcagcgagcacggctttgtcccagctggcaggattcccgatccggattgccgtcgcaacggtttctggatttttaatgacttcgccgcggacgatagccgcagaaccttccgcttcaaaaccgcgcatcttcggaagtccggtgccgtttttctcatgatattctttgaaccctttccagtaggccgtgatattcccggcatttcctaccgggatcgccagaatgtccggcgcttcgccgagctgttcgcatacttcaaaggccgctgttttttgcccttcaatccggtaagggtttactgaattcactaatgcaatcggtgatttttcacaaatcgaccggacgatggccagcgcgtcgtcaaagtttccgtcaatcgcgatgatttccgcaccgtacatgacggcctgcgcaagctttccgaaggcgattttcccgtccgggatgatgacgatgcatttcatgccggctctcgccgcgtatgcggcagccgcagcggatgtgttgcctgttgaggcgcacatgatggtatcattgccttcttctttcgctttggcgaccgccatgaccatgccgcggtctttaaaagatcccgtcggattaacgccttctgttttcacatgcagttcaattccgagcttttcagaaagcttcgggaggtgaatcagcggcgtgttgccttcatgcaatgtcagggccggcgtccgatccgtcaccggcagaaattctttatattgatggatgagtcctttccacattagctccaaccgttcccttctacacgatatgtgctttttacttcttgtacaacttctagatcatttaagttttgcagaatgtcactgaaatcttcttccgatgtatgatgcgtgacgatgacgatttccgcgagatcgtcatgtccttttatcggcagctgcagaattttttcaaagctgacgccgcgctctgagaaggccgatgtgatttttgaaaaagagcccacctggtctttgacatgaattcttaaaaactgctgggcgtagatatcagacggctgcttcagatttctttcaaactgcggggcgacaaagctgtttccgtttacgccgagacgcatgtttttcatgaccgcgaccagatcggaaacgactgatgtcgcagtcggcatgcttccggctccggggccgtaaaacatcgtttcgcctacggcttctccgtacacgtaaacggcattaaactcgttatgcacggcagagagcggatgatgatccgggagcagtgtcggctgaacgctgacttcgattttattgtcatcacgctgggcgatgccgatcagcttcatcgtatagccgagccgtttgctgaagctgatgtcttcatccgtaatccgggaaattccttttaccttgacatcgtccagatcgacgttcatagagaagccgagacgggctaaaatcgccatcttgcgtgcggcatcgagtccttctacatcggcggtcgggtccgcttccgcgaatccgagatcctgcgcttccttcagcacttcttcatacgggcttttttctttaatcattttcgttaagatgaagttcgtcgttccgttgacgattcccatcatttttgtgatccggtcagaggaaaggccttcttcgagcgtgcgtaaaatcgggattccgccggcgacactcgcttcataatacaagtcacagccattttcctttgcggcggctaaaagctctgacccgtatacggcgatcagatctttatttgcggtcacaacatgttttttcgctttcaaggcatcaagaagatattgcttcgtctgttcgacaccgccgatgacttcaataatcacgtcgacctcagggtcatcgatcacatcatagacttctgtcgtcagcacttctttcggcaggtctgcgtctcgttttttatcaatatctttaaccagcacttttttaatcgtcaccggacagccgacctggtgcataagcttatcctgatgatcttgtataattttgacgactccgcttcccacggttcccagtcctaacagtccaatacgaatcgcttccaaagagaaactccacctttcttccttttgtccactagaaaaggacaattgttaacccttcacagacatttaagttacaaatattatataagcccgcatttgttttgacaagcggctgaatattgtttctacggccatgaaaacgcttaacacattgatatgacaagattccctattttctaaatatttttacgttatattttcttacgaactgattccttttccgagccacgccacaggcgggacaaaaacctgcgccgacctgacattcatcatgtcgtgacatgtctgtaaaaactgttcatagcgggtgcagtcggcaagaatgtagtcaagctgctcttcgtaaaactgtttttcagaatcatgagaaatgtaataactctccaccgtctcaaagaaatgaagcggaaacagcaggcggctgtaaaacaggcgcttggaaaaggaggataacggcgtaacttgctcatattcctgcaaaaacaaaaacccttcgttaagcaagtcgtcacgatgatacaaatatgtgctgcgcatatattccgcaatatcacgggcggcatggtcgaatacccaatcgcccggaatgcggatcaatgattcctccgaccaggtatcccgttccatccgctgatggcagattgtccccgagtcttctgcgccgggattgtcatccagctccgtatccactaaatattgaatcgcattttccgctaagcctgaataataaggaaatgcttcgatcattttcttttcgaacggttcaagcggagacatatgaattttctgcatccagaatgattccagctgatccacccgttttccccataagtccttccattggccgatcctgcccgcttctttcacttcgtacggaaaaccccgcccttttctgtgaaattcggcaagctcccctccgacagagaacgaccggtttgcgacggggatcggcgcttttaagagcgcatacgttttgccttcgtcctcaaaggtcagttctccttccttcgtaaagataaacactgaaacgtatgggtcactttgttcttgtaaatactgactcatgtagtaaagctccgtcagctctgattgcgaaaacccggaaacgggaataataagaaagaaggaattaggcgtctggaagcattggtatttctgataaacggaaagctgtctgacgtggatgccgtacttttctttaatgatgcttttcatcataatcacctgcctgaaaaattagagctattcacatcgtagtcatacgccggcggaattatgaatacatattgtaatcctttgaatcaagtggagaaacatcgtacacatcggaagggtgttgtataaactagtaaaaaaagattgggtgaagcaaatgtcagaaaaggaacaactgaatcaggtggaagctgtcgccagagcgcgtttaaaagaacgggggttgagacggacgatattgccgagctggtgtatttccttcagaaaaaatatcatcctgatttgacgatggaagtatgcaggctcaatgtggaccgtgtcatcgcaaaacgcgaggtgcaaaacgccattttaacgggaatagaattagatgtgctcgccgaacaaaaaaaactgtctgaaccgcttcagaccattctggcgattgatgaaagcctgtatggggttgacgaggtgctcgccttctctatcgtgaatatatacggctcaatcggctttacgaattacggctacattgacaaagaaaaacccggcattctcgggcggttaaatgataaatctacgggggaatgccatacgtttcttgatgatatcgtcggcgcaatcgcagcagcggcttcaagccggcttgcccacagcgccagaaatacagaataaggacggccgtcatggccgtcccttttttatagatgttcaatccattcggttaaagagtcaatcgcatatgtcggcttccggtcgtaatctgccatatgctcacgctttgtcactccggtatgaaccagcagcgtatccatgcccgcattgaggccggccataatatccgttgcatagttatcgccgaccatgagtgtttcggaaatatccgttccgagcacacgcatcgcctgttccataataatggattcaggcttgccgataaagacaggctcaacgcccgttgacaccgtcaaaacggatgtgagcgaaccgttccctggtaaaagccctctttcagtcggaatggcgacgtcgccgtttgttgaaatgaaccgggcgccgtttctgatcgcaaggcatcccgttgccaacttttcatatgtaatgccgcggtcgattcccacaacgacaaagtccgcgttttcttctccgaagctcagcccgttttcttcaatggcctggcggatgccttcttcgccgatcacatacaccgacgcgtcttttttctgctgggcgatatgctgcgcagtcgccatgctcgtcgtgaagacctgctcttcagttgccggaatgtcaaagctcatcagcttgtccgccacctgcttcggcgtccgggaagaattgttcgtcacgaataaatacggaatgccgcgcgctttaagcgttctcacgaattcacacgcttcttcgattttttccgtcccgttgtacattgtgccgtccaaatctatcaaatatcctttataatccttcatactcaacactcctgtggattttctcactcgttgttatttaaatgcggaaacaggccctaattctgtttccaggtaggttcttacacgggccggaaaggctttcagcacgtccctgtttgacgtgatcagcgtaaacagctcctgatgatcggcttgctgatattcctgaacaagccgctttctggaagagatcagctgcttgagcttattcgcttcatcctcagctaccaccttttcatccgtcagaatatccatgatgtcgtcataactccccggatcgcgcatgataaagccgtcaatcatatcatttccgacatcgagaatgcattcgatcataagatggctgatccgctcaagcgcccttttttcgatttcgctctgccatgcaggcgtgctgtcaaacagcgccagctgggtctcaaaaaaacggagtgtttgttcgatattatttctgtcaacaaaatacacgtgacagcatccccttctgcatcaattattttctgattcgttttaaaacaaaatacgcgcagccgaaattgcagtattcgtaaatgtattcgtccaatgtgctgattttcgtttcaaaggttgctttttgattctggtcatcaaagaagcctttgagccgcagctgactgtatccccagtctcccacaatgtaatcatatttatttaatatgtccgaatagcgggctttgaacgcttcttcattaaagccgtttttaaaatcgtgtacgagttcaaactcggcattttgaataagaatcatgtcttcacctcttttatcactctttactatcataattcattgacttctgtccatcaattgcaaaatgagacggttcggacggacggaaaaattttccccttttatatccagtgtagcggttctgacgatccttattcaagaatgactttttccctgcacagacggctccatcacaaaaaacccaaaacctgcggcgttttgggttttttcggcttatcttatgcttgggcctggcgttttttagacgcttcgttcacttgttcatccgcatgataggaagaacggacaagcgggcctgcttcacagtggctgaagcctttttgcatcgcgatttctttcagttcggcaaattcgtccggatgataatatttttggacttttaaatgttttttcgacggctgcaggtattggccgatcgccatgatgtcgacattgttcgcaagcaggtcgtccatcacttcaataatttcttccttcgtttcgccgagaccgatcataatgcttgatttcgtcgggatgtcaggctgcatttctttcgcacggcgcaagaattccaaagaacggtcatatgttgcgcgggcccggactctcggtgtcaggcggcggacggtttcaatgttgtggttcagaatatcaggacgggtatccattaatgttttcaggttgtcgtaatttccgcccatatcggatggcagcacttcaattgtcgtgaacgggctttttctgcggatcgcccggaccgtttccgcaaagacgcctgctccgccgtctttctgatcatcacgcgccacggccgtgatgacggcgtgctttaagttcatcagtgcaaccgaatcagctacgcgttccggttcctgcagatccagctcagtcggcagacccgttttgacagcgcagaagcggcatgctctcgtacagacggaaccgagaatcatgaacgtcgccgtacgtctgacagcccagcattcatggatgttcgggcattttgcttcttcacatacggtatgcagattattttcacgcattaattttttcagacccgtatagttttcattcgtgttcagctttattttgagccattccggctttctcagatgctcgtctttctttgccatttccccatcatctccattatccctttattcatgttcgtgtgcgaaaaatttctatttcacgatggatataaaacttgcagatttctattcaatagtcactttaacataggaaaaatttctcgacaagggaagagaattacttacattttctcggattgttgccgcaaactagttgtattaatcctgaaaggagatcatgttgtgaaagttctgttatctgctcttctccttttatcagttttctgtccggctgcaagcgggaaagaacaatcggctcctgtttacggtgaacggatgcagttgtaccgcaaagccgaagcagtcacgcagattccttggtatgtgcttgcggcggttgatcaatatgaagaaaatgtccgctcgaaccgaaaggatctgccggaaaaagcgggaatcatcagcatttatattccggatcatttgtggagcgggcctgaaaatccaaatcctaaggacgaggcgcccctcagcattaaagtatttgacgggatcggcctggacggcgacggcgacggaaaagccgaggtcagcaatgatgaggatatcctttatacatttgcacagtatttagcgggattcggaacggatcttgaccatatccgcatcggcctctggaattattaccgccgtgatcagacggtcggcattatcaccgaattcatgacactgtttaaaacgttcggccgccttgatctcggagagcacgcttttccgcttcccgtgaagacggattacagctaccgcagcacatggggcgccgcacggggtttcggcgggcgccggattcacgaaggaacggatctgttcgctcattacggactccccgtcagatcgacctgctacggtattgttgaaatgaagggctggaaccgtttcggcggctggagaatcggcatcagggatatcaataacacgtatcactacttcgctcacctgaacggctttgcaaaaggtgtgcataaaggccagatcgtcaaacccggagaggtgatcggctctgtcggcagttccggatacggaccgccgggcaccgcgggaaaatttccgccgcatcttcactacgggatgtataaagataacggcagatcggaatggtcttttgacccgtatccccatttaagggcatgggagcgaaaagaaatccgcaggaaaaagtaaacacacagccgccaggaaagattgcggctgtgtgtttttatttatctttcttctgtttttcactcggcagctggacagaaggcgtcacacctgatccgccgcttccgttataaaactgcggcacctctccttgaatcgctttaatggagaccggaatattatttgtgacgactgatgtcttactggcaaacggaataatgaccttcactttaatttccacaaaaatactgatatcgatcagggcattgttaatgccgtacggctttatttttgttttcacatcagttaacgcatcaccgatcaggttaaagcgcacggggattttcggccccagatttccgagaacgctgtttcccgtgacctgccctaaagggatgttaatcataatttcatcggccgttttcgcgcctttttccgtttcatgctgcttattgttcgactccgcttccttcaaatgagcctgaagctgctttgtcactttcgccttcatgctgttgaccatttgtgtattaaaatccatcgttgtgacttttccgttttcatccgttttcatatcgaccatatctttcacattgtcgctgtgagacatgtattcttcaatggattccgtaatgacctctgtcgccacccgtttggtttccatttctcctatgttcatcagcaccggtttgattgaggagttgatcatccagaggctgatgaccgtcgatatgataaaaaaagcaaacgacagaagaagcacatatcgaaaaggcaaaggccctctcttgcgaagagcgctccggtatctaggcaagaaaaatcccccttacatatcacaatgtatgcttgtaagaggggacatagtattttatttttgctcttaaaaagtcccgcttaccttcattcgggtgagatggaacggccggcggatatttgacattacgcttgccgcgcgagcttccaggcgagcagatcccttaaaaactccggcataaaatattgtttttcttttgaatcgcggatgtaagggaacagctttccgagtgtaaacatgtcgagaacggcaaccgagtatatccgctccggatccacctcttctccgttcactttcacattgaggagatgcgtcacaccgtcttcaaggatgccggcctctgcctccgctccggcatataccatcctgcccatcacttccccgcggaagccgaggcctttaatccgcagctgctccatttgttccgaggcggcctggctgattgtttcccggagttccctgcctgaaagacgaacggcgaccggattgatcggatgagggcagatgcggtgcaagtcaagttttgtgacaggccccttctgtaaaggccccaaaatgacgcctgaattcaccatgctgacttcacagccgcaccagcttttcagcgcttcggctaatagaagcgggagcggcgattcctcaaaccacttcacgccggcttcttcattcagattggcgacttgtacggagagcaggttttccgcttcccgttctttctctttcagaaaagccgccgtatcttcagattccccgtgccaatcagccattttctgtacagatgcctgtttgctgacaatggttcgtgattcactttctatcgtcagctcgacacagccgacatagttcccgtatttctccgcacatgcaagcaatacgccgtttatatcctgtccgtcctcaagaaggtggtgcgtatgtgattcaagaatgacatcgatgtcgggaaatttttccgctgcggcccggtcatcgatcaggcctaaatgagaaagcagaatgatgatgtccgctttgcccttgatatcgtcaagtgattcttgaatgcttttttccgcatccgtcaccgtccagccgagtttctgatagacgggataatacggcaccgtgaccccgagtatgccggcggtcatcccgtttttcagcgttttgatcacgtagggctcggcccattccggccgctgtccgtccgcgtcaaacaggttggacacaatgacgggaaacgcggcatgagtatataaacccgccagctcatcgtgaggcagcgtaattccttcattattcccgacggcagccgcattgatctcaagccggtttaacaagtcgacattcgctttgccgaaggtcgcttccgttatcatttgaaatcggtccatatgatcgccgatgtcgaatacgagtgtttcctccccgtttttttcatgctcttttctcttctgctcaatataatgtacgattttcggccaattttcgaaatggctgtgcaaatcattcgtatgatataaacggagtttctctaacataccatctctcctaccttttagctgaatatcccttgataaatcaattcacagccgatcaaaatcaagacgacccgcatgaaaagcacgatcgttttcgtctgcacccgcttattgacccacgcgcccattttcccgccgaaccacgcgcccggaacgaggcacagcgcatacagccaattgacatggccctctgcgatatgtgacacggaacccgtcacggaggataagaaaatgatgagcattgacgtcgccacagccactttcggcgggaacaaaaataacagcatcatggccggaaccataagagagccgccgccgatgccgaaaagaccgcccaataaaccgacgaaaaaggcaatggcgataccggtaaaaatacggtacgaatatgtataaagctcacccgtttcatcctcatatgtccggatcatgcctttatgcgctttattgaccggttttgctttcgccttcagcattaatgtaatagaaatcaaaatcataaaaagtccgaaccagacggaaaacgtatgcgcattaaaaagtttagacaaatacgcgccgatgatgcttcccgggccggaaccgataaaaaagatcagtccgcttttgtagtcaacggttttatatttcatataggccagagttgatgacaggcccgtaaaaataatcaccaaaagggacgtgccgatggcagtctgcggtgttacgtcatggaaaaacggggtcatcgtgcttaaatagagcatcgccggcacgatgataattcctcccccaagcccgatcaggctgccgaccgttcccgcgataaatcccaatataatcaaaataagataagacatgtgtcttgaaacctcttttctagctgaataggtcgagctgcttcggagcaagcccggtatatgagatatctaacatttcaagcatctcaagcccgttatcggcggcgtctccgcctgagttattgttgaagagcacatacagattgcgcgactgctttttcagctcctgaagattgtttttccaatctttgagctcctgtttgttatagcggtataaatatctgacctcacgccagttttgtccgccgtcaggtttgatccagccctgcttgttccgtccatgaaaacggacaagcgttttttcttcatccgttgctttcaggacggtcggaatgctgccctcgccgatttgcggctcgtcacatatgctgtgaatccagccttcctccttcataaaggaaagcgtctgttcgtaaaatggcggggaaaaccaagatcggttgcggaattcaagcgcgcacgggatatcgcccatctgcttcctgcaccatcttaaatatgcgacgttttctttcttgcagtcaaaccacggcgggaattggaacagcaccatggcaagctttccatgctctatatacggcgataatgacagcttaaacgcctcaaacatttcttccttcgattcaaagggaatatcaccgcgctgatggcccgtcattccttgaaatgccttaatgacaaattgaaaagattccggcgtctctttgacccatctttcgttattgcgggcgggctgtatcgcgtaaaagctcgcgtccagctcaacgatgggaaaatgggaggaatacgcctgcagtttttgcgggcccgctgttttaggcggatagatgctgtcatgatccccccaccccgtcagtccgatataaatcacaatccttcacctctcattctagtttatcacaggtgtttttctctttccgtttccatgttttttctgaatgcactttgcaggtaacggtactgatgttcattggtgtccgaaaatgcctcatctctggaagaaagaatatgctgatagacgatcggctctgaaaactgaccgctcgtgaaatcatatatctccccgtctattcgattataaaaatgccagcttgtgccggtttttgttttgagaatgtcaccgccgtaaacatcttggatgactaaagccgtcacgccgcactggcctgtggccgggcaatcttccgtccattttgtactggtcttgcgcgaccaggatgccgttaatatgttcaagatttgatcatacaatgtgttttactcctttttataaaaagataccacgagacccgctttccaaacgacaaaaaaagccgattctcatcagagaatcggcttttttatttcacaaggcttcaggaatgttccgaaagacccgctctgcttacgaccgccatcctgatacacacagcaccccttgctgtaggtcgcagcaattcggtatggaaaggtgcggccttcatacaggctttgcttatgtttggaaaacatcgtttcttttgtgacggtaaaaggttccggccggacaatggcaaaatcagcgtcaaatccttcttcaagccggcctttattcgttaaaccgaaacgcttggcaggtgcttcggccgtccatcgggccacatgttcaaacggaatcccatgatcgatcgctaattgaatcatgccgagaagcgtaaattggcctccgctgatcccgccccacgacaggaacatattatcctcgcgtttcaaagccggatgacagggagaatgatccgaagacaccatatcaatcaggtcttcagccaaaaccccgatcaattcctctttatcagcctctgagcggagcggcggagcgcatttggcagccgccccttttttgaggaagtcttcaaagctgaataataagtagtgcggacacgtttcaacggtgacatccaatccgtcttttttcgcctgctgaatggagagcacggcccgtttcgtgctgatatgtacaaaatgaagcgcgcatcccgtcgctcttgcatattcaatcgcccgctgcacagcctcgcattcggcttcttccggacgggaggaagcgtaagcgcgggcatcaattttcccttggagcgcgtactcggcttcaaggaatcgggtgagggcgtcgctttctgcgtgcagggccaaaatcctgccgcacgccgcgatttccttcattccctttaaaagagtccgttcatcggctgattgaaattcatccgttcccgatttagacagaaacgctttaaacccgattgcccccgcttctgccatcggccggatatgttcggtatacccgggcatcaaaccgccccaaagcgcaaaatcaaccgctgacttccgttcggcgatttccgcctttgccagcaggttttcagcagttaccgtcgaaggaatgcagttaagcggcatgtcaaaataagccgtacagccgccggcagcaagcatgtttgagccggtttcaatgccttcccattcttcgcgtccgggttcattgaaatgcacgtgacaatcgaccgcgcccggaaacacatacatgccgtctgcctgcaccacttgttccgcgttttcgtcaatgccgggctcgatcaatgcaattttcccgtccttgacggcgatatcggcccgctctgtcccgccttttcgcacagctttcgcaccctttacaattacgtcataggccattttatcttcctccctgtaaggatgacgattttctgtcagtttttatcacaacatgcgtctatgattgccagtttactgctactatgatcgtaatacatcagcaaaaccgctataatttttgatgacttttattcatattaaccaatggttgtctttagaacctgaaaggagattgactgatgaatatttatgatgtgatgaagattcccgcttatgagcgggccgcattaatcgcaggcagatccggcggctggagggaggtgcagcacgtcaacatgatggatgcgccggacatcgctgattttttacataaaaacgaattgctcgtcacgacggcttaccacttgaaggaccgcccgcagctgttgaaagatttaatccgcctcatggcaaaacggggatgcgcgggactggggatcaaaacgaagcgctatcttaatgtcattccgaaagatgccgcagagcttgccgaccggtatgaatttccgattattgagctgccggaagacatcaggctgggagatatcgtcaatgctacattgagccatattcttgatatgcgttcaaatgagctgcagcaggccatttacgcccataaaaaatttacaaaccacatcatgagcggcaaagggctgcaatccctgcttaagaagctctcagacattctccggcttcccgtgctgcttttggatcagcatacaaaactcttatcatcgtcccacagcatacccattgacacgtctttattgaaaaacatctgttattccctttccggtccttatttcacctgcttttccatgctctccgacagaaaggtgtattctgtcctgccgattctgaatgttgaaaaaaactgcggttatctggtgattccggagctggtgcagaccgctgataaaggcatgattttgacaattgaacaggcggccaacgtcatttcctttgaactgctgaaagaaaatgccgtcaaacaattcggcagacgggcgcgcaatgaatttttcagcaatttcatcgaccgctcgtttaccggccatgaagaaatcaaaagccgtgccaaagaattccggctccgctgggatcagaaatacatgtgcatttgcggaaaactcgaccgaaatgagaaaacgatcagctttaccgaaaatcagctcgtttccgatcatgtatttgatctgcttgaaggggagctgtcatcctttccgtttccccctcatctctttattaaaggaaatgtcggtattcttttaattgaagcgacagacagctggaatgaaatgcacgcgtctgtcatcagctttttggagcagtttcagaaacaggtccggacgcagtttaaacggactgtctccttcggcatctcaaacatatgccaaaagctgatcgatgtccctgacgcttttactgaagcttcagacgccatttcatccgggcatttgtccagaagcgcggagtttattcaaatctatcatgccaaagacgtgccggagttgctcggcctgcttccggcggaagatgtgaaaaagttttacgaagccaccctccaaagcctggccgaccggcaaaaggaggaccagagcctgcttcatacactgtctgtttacctggaaacccactgccagatttcagaaacggctaagcgcctgtacgtccatcgaaatacggtgatctatcgtttagaaaaatgcgaggaactgctcggcaaaagcttaaaagatccggagacgacgatgcgcctgcggctcgcgctgagaatgcagcggctgatcggttaaaatttagccatagaccaggatgcgggtgttctcccgcatcctatttaagggggattcattcagctaaaccctcaaaaaatgctgccattgatatcatcaggctttttcgatattcaggatgcaaccgataatctcaccctttttgatttcatcctaaactgcctcggaacctttgtcacaagcacccatgacccttttttgatggtttcgccattcatttgaaaatcagcggggagcgacacaagactcaaccacttccccacgccgccctgaaagtcatgctgcttttccttttctgatttcataaaaaaaccgcttttgattagcagccttatctacgtaagaaacatgtatgatgtttgcatttatcaattcacttggcatgtgttcactcatttcaaagaatatttaacaatttcttcattgttatatttccattaagtgttactgttatcctataaataccaaaaggaggttttacgttgaaactagctaaaaatgctttgttatcacttgcaattgtttcattcgttttcgcgcctttttttaactcttcagcatcagccgccggtccctctactaaagtgaataagaatttgtttcaatctcagtctgaaacccgcgtcaatttaaaagtaggagagataaggaattattctacttctggtaatcgcatttcctttaatcctacgggttataaccctcctgctgtgacatggagagctttaggtactgactacaaaaccattcaggtatttgcagtcgctaaaggagaagcctggattgaattctatgatgattcctccacttggaaaacccgataccattttgtagttcagtaataatccgaagagatagattctatctcttctttttaattaaacgattgcgacgttttgaattttttatttttcctcaactgacagccccaaaatctcgttatctactacaggagacagaacgcagtgacaatgaacccgctcagcggcggaaagctttgtgtctcgcggatacatacaggtttcgctgcttcctggtatcttgaattcttcgtcaacaccaacagtcgaacacatcaagaccaaaaaccgcttctgacaggccgcgcaaggggattttataaaatttctgaaaaaggaggggcgcttcccctccgtgaaccgtaataaagcttcgtgtgttggctaatggctgtctggataatggtctcactgtcatcctggaaagatcacttacttctataagtctttctttttaacagaaaccgcagatatagcagcagaaataactatccgctccgcttcttatgcactctctgtaacatggggaattataaaaaggagggcgcgcggaaacatagggggagccccctgaatgagtcaattgatgggcccatggataataattaaattcttgccgctgatacaaatggaatgacgggtaataatacaacattttcaactccttttccgtacaccatattgtacttaccgacatcctttttagatgattgtctcttgcataattgtgtgttggcctaattgcgggttttaatctgcaaaattcatgcaggagaaccatcacaacatcttccgggagaggttttataagataacctctccttgttgtcaccaatcgccccctactgaacagttcgtattatttcaatgacccgttttatcagaatgctctccccctgcatacgaaacagcaagttccaaaaccctgctttttccttctcagcatttacgccgctcaatgttgtccctgcctgcctgactgccttcttttttgatcaacttccggcagatcaaattcatcagactcgtcaagcgataaagctggttttactttatctacacctgttccggtttccattcgcgccatgcttgagcatacggaacaactgtttttgctatatgattttccctctatgcgcatctctgcaatttcagagatgcagacagccgcagaataaacgacaatcagcaaaaagcctccggatacccggaggcttttgattcttatccttgctgcgtgaacggccgggtctgtgtctttttgccccagccaagcgcggccagaaaactgatggcgagaatggccgctcccagcatatacggaaattccatatttacatcaaagagaaaaccggcggccgacggcccggcgatattcgctaagctgatgaatgaggtgttcatcccgccggcaaacccctgctggtcaccggcgagcttcgacagcatcgtattaacggccggccggagcagcgatgtcagcgtcaggaaaaagattgccgcggcaaaaacggcccaatatgaacccgcaaaccggcaccacacaagtcctgcagcagccccgatcaacgtcacgttaatgacgcgcttttccccgaacctgcggacgagataactgacgccgaccgcctgcacaaatacgccgatgagacccgcagccgtaataataaaggcaatatcagaggctttaaatccgtgtttatggtcaacgtaaaggccgaaaacggattcaaagttcataattccgaagttcagcacaaaaaccagaatcagcataaacgcgaacggcgatttgagcgcgcgtgacatttgcttaaacagatgctcacgtttttccgtttttgcccgggcttccagctgcttttcacgccccagcgtttcgggcagaaagaaaaatgaaagcaccgttgaaaagcaggcgagacttgcggacacgatgaacggcacagacatgccgtaatgaaccaaataaccgccgacaccgggcccgatgacgacaccgagcgtcatcgccgcgctgaacagccccattcctttcccgcgttcttcctcggtcgtaatatccgcaatgtaagcgaacattgacggcattaaaaacgccgcgcccattccgcccaaaaggcgggatgcgaacaattgccacaggcttccggcaaaggcgaagatcaattgtgacacggcaaaggcggcaatgccgaaaataatcagtttccgccgtccgtatttgtcggttatttccccggcaataggcgcaaataaaagctgtgtaagccccgccgccgcaacaagcagacccatcgtgctccccgtcgctccgaattcggtaatatatgcgggcataatcggaataatcaatccgatcccaagcatcgcaataaacatattcagcattaaaattgacaatcgccccatgtacgccatgatttcttaccttctccccagacaaacagatgatcattccatatttgtcattttttataccattcagtataacggggaaaagggaaaaaagtccagatgatttcaatctcgttttcatatctcatgacagcataccggtttcagccggcagatcatatatgttaagggccgcctgcagcgcttccccggctttaactgcaactccgtgtctgatcagaaccgcttcaagtccggccagcacaaacagcacattttcctttctgcagctgtagcccatcgttccgattctccaaattttcccctgcagcggaccgaacgaactggcgatttcaattccgaattgagacaaaagcatactccttatcgattcgccgtctgcttccggcggaatcttcacacatgtgacgacaggcagcttcgcctccggatcgccgaataaatcaaggcccattgctgcaagtcccgccgtaagcgctttttcatggcgctgatgcctgcggaaccgttcttcaagtccttcttccagaacaaggcgcacaccctcccgcagcgcataaagcattgctgtcgcttctgtatggtgattcagccttctttcactccaataatcttcgagctggctcagatcaaaatagttgctcgtaaccggccgatgaccggacagcattttaccgtcagctgctgtcgcaatgccccgttctacctttttacgcgcggcaatgacagcggccgtccggtcattataagtaatcggcgccattccggaagggaccgataggcatttttgcgttcccccgatgactgcgtcaatcttccattcatccgtttttacggcgcatccgccaatcgtggccacggcatccacgataaagagtgcatcttgggcgcggcacgcttccccgatttctttcagcggatgaatccgccccgttgatgtttctccgtgcaccatagcgacgattttcggggaaatctttttcatctcgccgataatctcttcaggccggaagaccgttccccattcacactcgatcgtatgaacgtccgctccgtaccgctcggcgatttcagtcagcaggtgtccgaagcgtccgtatatcggaacgagcacgctgtcgccaggttctatcacacttgcgagaacagcctcaatccccgctcttgatgtgccgtcaatcggataggcccagcggttttccgtttgaaacaattcacggagcatttgcatcgtttcgttcatgataccggtaaatgccgggtcaaactggccgaggatcggagcgcccatcgccctcagcactctcggttcagcttctgtcggtcccggtgtcattatcgttctttgcggaatgcacaattcttttctggtcggcacgccgattccccctttacgttaataagcaagtttatgtaatacattcgccagcgtaaggacgccggtttcaagctgatgtgcgggtgtgaattcaagcggcgagtggctgatcccgccacggctcggcacaaaaagcatgcaggccggaaaggttctgccgagcatctgggcgtcatgtcccgctccgcttacgatcttctccgggtccgccccctgctcttttgcagcctgtgctgcggttcgtgtcagtatgtgatccatttgaaccggctctatcctcatatattcatcaataaagggtctgactcctttgctgcggctgatgttttcaataatcgacaccagtttctgatggaaggctgccagcacgtcttcctgctggtggcgaatatcaacggaaaactggatacggcccggaatgacattcgccatattcggctcaaccgtcattttcccgcacgtcaggcggagctcttccggctgtctttccgctgagagcatgagttcatggatgatgctgcttcccgccgcgagcggatctttccgccatttcattgaagtggtccccgcatggttgcattcaccgtcaagcgtaacggtatagcgtctctgtccggcaatcccggtgacaatcccgatatcctttcccgatcgttcaagcgtttgcccctgttctatatgaatttccagaaaggcactaatatcagtgcgcagcggcgccggataacggcctgcaccgaagccgttctgccgcatggcttctttcagagaaatgccggacgcgtctttcggcgtttccgcatctgaaagcgagaaagcaccggtgatattgcctgagccccaataggtgatgggaaaacggctcccttcctcttcacagagcgacacagcctccagcgtttttttcggacgcccgcacgtctcatgcaaatgccggatcgccagcatgcccgccagcacgccgaacgcaccgtcatatttgccgccgtcaataacggtgtcaatatgcgacccggtcagaatcacctcatcaggcgattctgtgccgctcagacggccgaacacgttaccgacatcgtcaaatgccgtttccagcccgaacgcctccattttctttttgacggcaagctgggcgtccatccattctttcgtatataaaagcctcgtcactccgccggaagcggaagcgccgaattgagacagccattgtatgtcatcggaaatcccgatattcgccgccgaaagctgctgatgttccatatatgccctccttttaaactgaaaaactgacaagatgatcttcattatagaaggagcgcataacgagttcattatcatatcttccaaaaaatcaatgattttccggatactttgaccaagaaaccgcccctctgtcccataagccgaaggaaccatttttcaaaaaagatagaatattagatttattttttggataatagaggtaaaggagggcaagtcatgacaaaaaaactttggtttctgccgattgtctgcctgtttttcattttgggttggaccgcgccgtcagcctctgcgggcgcgccggctgacacgaatctgtacagccggctggcggtttcaactgccggcggcacaactctttttccgcaaacttcctcagctgtcatcactccgtctgcggatacggagacatattacaaagaagcttccggaaaaagcggaacagccttaaagagcgccctgcaccgcatcatcagcggacatacaaagctgtcttacagccaagtatggaatgcattgaaggaaactgacgaagatccggcaaacccgaacaatgtcatcttgctctacacccaggaatcacgggccaaaagtaaaaacggcggcagcgtcggggactggaaccgtgaacacgtgtgggcaaagtcacacggaaacttcggaacagctgccggccccgggacggacattcatcatctgcgccctgcagacgtccaggtgaacagcgccagaggaaacatggattttgataacggcggctcagaatacccgaaagcgccgggcaattattatgacggtgattcctgggagccgcgcgatgaggtcaaaggagacgtcgcccgcatgctgttttacatggcggtgcgttatgaaggcggcgacgggtatcccgaccttgagctgaatgataaaaccggaaacggctcagctccttacatgggaaaactgtccgttttgctcaaatggaataaacaagaccccgtcgacagtaaggaaaaacggcggaacgaaatcatttacgaagactatcagcataaccgcaatccgtttatcgaccacccggaatgggcggacgaaatctggtaatcgtatcataagaagtgataagggagccccatcatcaggctccctttttcaatatacggcgttttcagtgtcggcatcaaaaaacacggcccggttcatattgaccgcaagcagaatggcatcgccgggtttcacctctgaagcgccgtcaaggcggatcgtcatgcggtcatctccgctcaccgcatgaacgtacatctccgcgcctaagttctcacatacttccgccacagcgcggcacaccgcttcaggcgggtgctctgattgtccggcaagcgtcaaatgctccggacgcagccccgcagtcatctcctgaccgctgtatcctttctgcacaagaacggccgctttttctttcggaatgggcagacgaacggacgaaccggcaaaataccattgcccgtgactttcttctatgacgccttttataaaattcatactcggagaaccgataaaacccgccacaaacatattcgccggataatgataaatctcatgggggcttgcggcctgctgaatatttccttcattcatgacgacaatccggtcacccattgtcatcgcttccgtctgatcatgcgtcacataaacgatggtcgctttcaaacgctgatggagcttgctgatttcggcgcgcatcgtcacacgcagtttcgcatctaagttggaaagcggctcgtccatcagaaacactttcggctcccgcacgatcgaccggccgagcgcaacccgctgccgctgtccgcctgaaagagccttcggtttccgcttgagcagatgcccgatttccaaaatatcagcggccgtccggactcgctctgcgatttcttttttcggcagctttctgagcttcaaaccgaacgccatattatcaaacaccgtcatgtggggatacagcgcgtaattctgaaaaaccattgcgatatcacgatccttcgggggcagatcgttcaccgcgtctccatcgatataaagcttcccttcagaaatgctctccagtccggcaatcattctgagtgtcgtagatttgccgcagccggagggaccgacaagcaccagcagctcctcatcctttacatctaagtgaaaatccttcactgccgccgattgggcgccgtatgtttttttgatatggtcaaatgttaatgatgccattcgaaacctcctccaatactggaaaccgccacatctttctgttatgttaaaaatgttcggggtttctgacagattcataaatgaaaggcaaatttgtattataacatcataatacatataatagtactactacttgacaaaggaggtccgtcccattgttaaataacgggagctcgaaacctttatatattcagctgaaacaaattatcgcggacgatatcaagaagggcgtttattcgccgtccgtaaaactgccgactgaaaatgagctgtgcgaaacgtacaacgtcagccgcataacagtcaggaaggccatccttgatcttgtggaagaaggctggctcgtccggcagcagggaaagggaacgttcgttaaaagccctaaactgaagcgggagctcatcgcggtcaacggctactctgaatttatggaatcaacgggaaaaaaaccgaaacaccagatcctttcccatgaaatcattgaagcgcctaaatccatcgctcaaaaacttcgcgtcgcttccgaaagtcccgttcttgaattaaaacgcattttatttcacgacgaccagccgctctcattcgaaatcgcccactatccgctcagtttatttcccgacatcggcaagcatattaaaggcggcgtgtcgatgcatgacattttgaaacagcactatcaggtggtgcccacccataatacgaaactgttaaatgtcgtatacgccaagcaggaagaaagccgctatctggcttgtgatatcggggatgcgctttttgaaattgacaaaaccgcttttatgtcaaaagaacagccgatatacagttcgctgtttttaatgcataccgaccgcgtcacgtttaccattaacagcccctatgcgtaacaagtataaaaaacgagacaatgcttatcgtattctcgttttttcactgcttttcccgccgtccggcctgtagggatgcccgtaaccgaacgctccgaaccccccgcatgttttggcagccgtcccggcggccgcagtaagcgctcgccgaatatcctgatgttcgaagaaatcggtaagaaacccggcgataaaagaatcacccgcccccaatgtatctattatatcagctcttaccaccggctgatgatagacgcgttccccatccgataacaccgcgccatgttctccccttgtcagacaaacgattttcgctccgaaaccgcgggctttttcggcaagccgcacacattcactttcactcaaatcactcccggaaaaaaacgcatacgtcacatacggacagaccgcttctaaataggcttcgtcacgttttacagagaaatcaaaggaaatcggcacatggccgctcagcatcggaaggtcacgttctatcctgctgtatacgctcgtatgcagcagatcatgtccggcgataaatgagatgtcattctcctgaaaagcgagcgtcagacgcgattgcacgccgcctttatttgatccggcaaatatcctgtcccctctttcatcaagcgtgacgaccgccatcccgttttctccgtatgcccggcggatcagatcggcattcaccttctccagtttcagcacattcaatacgtgatccgccgcttcatcactgccgagaatcccgatataagaagtttcgtggcctaagcgccgggcaagcacggctacatttaacgcatttccgcccgggtaaaacgtctcctgatcctgataataatctactacattatctccggccgctatcagtttcatcttttcatcccccttatcctttcacgcttcccgctgcaatgccgcggataaaatatctctgcattaataaaaacagcgcgataataggagcagcagaaatcgtcagcccggccagcagcacgccccaatccgtctgcagcgcatctctgaactgcatcagcccggccggaatcgtccgtaaattttcatcatcgataaaaataatcgcaaacataaactcattccatgtatggtaagccgtcaaaatgcctgatgtcaccagaatcggcacgctcataggtaagaatattctgaaaaatattccgaaacttgtacatccatccagataggccgcttcctcaagctctttggaaatcgacaaaaaataggaacggatcagaatcacggtaaacggaatacgataggctgcgtacggaagaatcaatgcccaatacgtattgtacagtcccaatgactggataatggagtacagcggcacaagactgacctgcggcgtcagcatcaagccgccaagacaaatgatcagcacaaacccttttcctttaaattgaaaacgggccagcccgtatgccgcccaggcactcacaaatacggtgatgagacaagtcagcacggtcacaatgacgctgttcataaaataagcggaaatcccttggttccatgcggatacgaagttttcgggatgccagacagagggcagcgaccagctgtgctcaaaaatctcatccgagcttttaaaggcgctgaccgccatccataacagcggataagcaacggcaatgaggtagataaagagaaacagccacacagacgtttccccgacataccattttctcggttttccgcctgttctgacggcctgacgggcatgacgcaagtccgtcttttcaggaagcatcggcctactcctcctttccggtcttaaagaatttcatctgaataagcgacagagcaagcgtcagcaaaagcaccaccgtcgcgatcgcagaagcgtagcccatcatatcctttgtaaaagcgctcttatacaaaaatgtgctcagcacttctgaagcattgcccggccctccgccggtcagaatatacggttcattaaatacggtaaatgcgccggtcagcgtcatcaccacggcaacaaacgacatttctttcgtctgcggcaccgtaatgtgaaaaaactgctggatttttccggctccgtccagctgcgccgattcatataattcagcgggaatgctctgaatcgagacaatgtacagcatggcgatgtaaccgacagactgccattgagacacaaaaatgacagacagcatagcggtgttttcatcgcccagccacgcccgggtcagttcatcaagtccgacggcttccagcagctgattcaaaagcccgatttccgggttataaataaaatcaaacaacagcgcaatgacggtcatggaaatgacgaccggaagaaaaaataccgtacggaaaaacggcgaccattttcttaccaatctgtcttccagcacggccgccagaattaacccgccgccaacctggcaaatcagcgatatgaccgcatacagcacattgttgcggagtgctgtaaaaaacacgggatcgtggaacaggtcaatataatttttcaaaccgataaacgtcttttcgggttgaaatgagctccattcaaacagactgaaaaacacattctcaataatcggaatgtaaacgaacagcagaaaaaccagcgcgggcgcgagaaacagatacggaatgaaacgctttcggctgaccaaagaaatcctcatctcctttctccaaagaaatctgttctattcagatgacgctttgacctgacgcgccgctttctgcacggaattcatcacctcgcgcggtgtcattgtgccgccgagcatctgctgaacgcctgccgcatacacatcggcgatttcaacgtcaacatccatatcaaaccacggcaccattgtttcggcgcggacgatatcctgcacggcttcgcgctggatcggggtggaattgttttctgtcgccgttccctgaaccgcgctgtatttaccgacgtcttttatcagcttctctcccatttttttcgaggttaaaaactgaagaaattccatggcttctttcgggtgcttcgtttttgaggaaatcataaatccttcgggagatccggtcagtgcacggggagatcccttttcgccgctgattttcgggaaaggaaacaagcccagattgaccggttcgacgagcttaatttctgccgtttccgcataaatcatcgccgctttgccgctcgtaaactgctggcgcacgtattcgtgatcaacggagttcacgtgctttgtaaagtacggcagaagttcctgaagcttttcaagcgctttgacatagccttcgtccgtaaactccccggtttccgggctgtaatccttcgcccgcgttttttcatccaccatacgctggttcagcgtcccgatataatgagaaatggtccaaggcgcttttgtgccgaaactgatcggaatatatccgttctctttcaatttctcacagactgtgatcagttcatcccatgtcgccgggggcttcaaatgtaatgtattaaaaatgtctttattataaaagaatgatttagcgtccatttgccacggaacaccgtactgttttccgtcatgcgtaaagggtttgatttgtgactgcacaagctgtgaggaccaatctttatcctgctgatagtaagacgacagatcgagggctttatctcctttgatgaatttataagcaaaccggtcgctccatgaaaagaaaatatcaggggggctcgttgttccgagcatgactttcaccttgtctttataagaatcgtttaagaccgcttccgtttggatatgaatatccggatgagcggcttcaaaatctttgaccgcttcttcaaaatagcttttttccggctccttcggccacctgtgaaaaaacttcagggtcacttttccgtcagaggaactgctttggcttgaacaggcggcggctgacagacatacagctaacagaacgaacaggcagatgagctttttcagatgcttttcctcctttgtcaccggactataacgttatatatcattatagtccggtgaaatataatgcgcgttcttaatattcgactttccacatgtaacgccgctggcttaacggatggttccttgcttccgccagcgcatccgcatagcttctgagcacccggtttaatacgagaggagccaggtagccttttacagaatcgtcaattccggaaaaatcatatgctgccgcatcaagcacagtcagttttttgccgtatctttttgagaaggaaagcgcccgctcttcaaggggtcttgtttcgtctaagccgagcaggataataaatggaacagattcatcaatgatttcgaacggtccgtgaaaatattctccggcatgaatggcgtgagaatgaatccattgcatttccatgagaatgcagatgctgtaggagtaagcgacgccgtagttcgcaccgcttgccatcgtgtaaatgatatcttctttttcgtgggctttcgcgaatgcctttgcgtgatccgcttcttgtttaagcgctttgtcatatacggtctggagtttattgagtccgtcgatcgcctgctcaaacgcgggatggttttccagcacgtgtaaagcgccgaacacgatttgatacagaaccccgtaattcgtatttatcgcctgtgcgttctcaccccagtcatacaccgcgacatattcggcttctttcgctaacggcgaatcaggctcaaaggtcattgcaatcgtaagcgcgcctttttttctggcgaaaccggcggctttcaccgtttccggcgtattgcctgactgagaacataaaatcaccagagagttctctccgagctgaatgggattgcgctgaataaattcatttgaactgtagagatcagagctgatggctttcgcctctctgtcaaacacgtacttgctcggatacataatggctgaagaacccccgcaagcgacgaaaaagacgtggtcaatcgtttttcctttcagatcatccaagaaagcctgaaccttgtgattcacttgtgcggcagtttgactcaaatccttcactcctcagtgttttattatataatgttatataacattatataacgttatattaatcgcaacaaaggtgcgttgtcaatcatattttctgaaatttctaaaatatagaataaacccgtctaatttcccgccctttcttgacctgacccttagagacacgtttagaatgaaaagcagggagtgattcagaatgaatataaaagaagccgccaggcagacgggtctcacgaaaaaagccatcaaatattatgagcaggaaggtttaatcaccgtcagcaaaaaccctgataacggataccgtgagtattccgctcagaacgtgaatacgctgaaaatgattgccgccctccgaatgctggcactgtctgtaagcgatattaaagcgttcctcttagagggcagcagtctgcatgatatactgcgccagcagcatcaaaagctcagccggcagattgaagagcttgagcaggaacggaaactgactgaaatgctgatcaagcgcgtggaagatgcggaaaatgtcgattcaattctgcatgatatcggcgaggtcaaaatagatgaaccgaagtatatgggacttcagctgaaaaaactgttcccgggagatttcggagaatttatcgccgcgctgtttgaaccgttcctcgacttttctattgatacagatgagaaaaaaacgatatgggcaaagcttattaaagtattggatgatatggaagaagttccggctgcacacccgatgatgcagctggtcggtaaggaggacccggctcagctccaacagcacaaagtccagcatgaccaatttatcgagcggattttggagagagaccccgccacttgggacactcataaaaacatcatcattcagcttgtgaaaagagtggagacagatgaagagtacagagaaagcctgatcaagatcggagaatccgcttctgatctgcccgcgctgaaggaaggatcgcctttcagcaatctacttcaaaagctcagcccgaaatatgacacgtatgtgcgacttcagcttgaactgaaaaaagaagccgacgaggaactcggctttgattcagaagcatatttaaaacagatgcttcaatcaaaaaaacgctaaggctcgtctccttagcgttttctttcttcatcctcagtgctgtgcgttaatgcggtcaacgacattagcgatgagctgctcttttcctaaatcggaatcttcgtcaacgcttgctactgtcaaaatgatggccgctaccgcaagagcgatcgtctcaatggcggccgccgcgtttaaaaatacccatacagcacacagccatcaaataaatactgaaaaatgaactttttcacactaaaatactattataggtaaaaaagggagtgttcatatgtttttgatgaatgataaggtgctgtggggagctgtggttctcgcctttattctgtcgattgtgttttatccgtttcttcctgctgatatggccattcactatgacgtgtcgaaccgtccgaatacatcaatcaataaaacggccggcgtcctgatttttcctgtgctcatgatgatctgcatgttattcagaaaaaaggtcgttcagctgttcctcgtcgtttactgtctgctgatcgtgcatattgcagtgatgtggctggcactgtaaacataaagaaaaccggagcccttaagctccggtttttcttatttataaaatactttctcaatgttgtatttcgactgaagggtattgatcgcgtacgtttcgtaaatctccctttccatcggatcattgacgacacatacttcaattttatacacttcgtccctgtgatgtttaacaggcgacacattgtcttcaaaatgctttttgattctttgtcttaatttacgggctttcccgacaaacagcagttcatcatgaatgttataaaacataaagatgccgcctttgtctctcggaatgcggtgaaaatcaatgaaaccgtaaatcgctttaatcgccggttcattttccgacggtgactgctgccgttccgtaatcgttacatcaggagcaggaaggtttatttttatcaaaatgggtcacgtcctcttattcattaaagctccatcctatcataagaatgcgccaaaagctattttttattcaagcgccccggccggatcataaaggctcaaatcaatttccgtctgctggccgagtgcgagtttcgccagttccgcccccagatacggcccgctcgtcagccctgaggcgcccagcccgttggcaacgaggagtccgctgatattcggcactttgccgatgacgggaagaaaaccgggagtaaacggcctgaaaccgactcttgtctctatcacagtactgtctgaaagccccggcgccacagttaatgctttgtcaaaaatctcgcggaggccgccggccgtcacccgcaaatccatgccggtatcgttttcatgagtcgcgcccgctatgattctgccgctgtcaaaggcgagaatgtattgatcgtttgggggcatgacgacgggccagccgcccgtatcctctccctgaagctctaaatgaacgatctgtgccttttggtatgatactgaaaaacggatgccgagcggttcaagcagctctctcgcccaagcgccggccgttacgagaacctggccggcagtaagcgtgcgttctgcggttttcacaccgataacggcaccgtcctctgtcaatattgacgcttcttcattgtaaacagccgcgccgtgattaacggccgcgtttaacagcgccttacgaagcgccctcccgttcacccgggccgcgccgctgacatgaaccgccccgtattcctccgacagcgcggggaacagcgccttcgtttctgccggagtcagtctcgtaatgtcaccgatttcaggagcgtcctctcttcttttataagctctttcctccatttggctgagctttttttcatccgtatggagactgacggcaccgaccttttgatagccggtgtccgtttctccgtcagcttcaagctgctgtatcaattggttataatagcgggctccgccttttgcgatcgcataccatgcctggttgcggcgctgcgacagccacgggcagacgatccctgcagcggcgtcagtcgcctgccccgggtgtttcctgtcaaagaccgttacatccgcaccggcctttgcgagatgataagccgcggacgcaccgagaatgccggctccgataatcatataagacttcatgtgtaacaccttttctatctgttttgtcttatttattttaacaaatagagcgcccggttcctaccggagtcctgacggcaatgataagtttcgaaaacggaaacgtataataaaaggaatacgttcttgtctgaaagccgttttcctcaagaattgctctgtattgtgatgtattttttatatctgacacggccaatgtgccgccaggcttcagcaccctcaccatttccgtgatcgcccgttccctctcttttctgcctgaaatgttgtgtgctgaattgaaagctttcccgagcgggatggtaacggaaatcaatacgtatgagaatatttggatagttcctgtgaacttgtgcttctcatcgcagattgctcgtatgtaacgttatattgcaaagatccggacatgctcgaagccctttttcagcaggctgtacaatgcgggtttcaccgcgttgactatgttacagataagaatgatgcgagaacgggattgtctgtctggtgaaggtggtgcgttctttttatgaagcgctggatagggcttaggattcaaaatattgacaaattcgtgtgttttcaacaaaaaaatcaccccctcatgtatactgagtgcgtaacttacatatgaaaggggtatggcaatgaaaatcaatttgaagaaaaaagcaggtttttggaagaagacggcggtttcatctcttattttcaccatgttttttaccctgatgatgagcggtacggtttttgcggccgggctgaataaggatcagaagcgccgtgcggaacagctgaccagcatttttgaaaacggaaagacggaaatccaatacggatatgttgaagcgttggatgacggaagaggttacacttgcgggcgggccggctttacgacggctaccggagatgcgctggaagtagtcgaagtatatacgaaagcggtgccgaataacaaattgaaaaagtatttgcctgaattgcgtcgtcttgcgaaggacgaaagcgatgacatcagcaatctgaaaggattcgcttctgcctggcgctcacttggcaatgataaagccttccgcgctgcccaggataaggtaaacgacagcttgtattatcagccggcgatgaaacgttcagaaaatgccggactgaaaacggccttggccaaagcggtgatgtacgatacggtgattcagcatggtgacggtgatgatccagactccttttatgccctgattaaacgcacgaacaaaaaaatgggcgggtcaccgaaagacggaacggacgagaagaaatggctcaataaattcttggatgtacgctatgacgatctgatgaatccggcagatgaggacacccaggatgaatggagagaatcggttgcccgtgtcgacgttttccgcgatattgtcaaagagaagaactacaatttaaacgggccgattcatgtccggtcaagcgaatacggaaatttcactattcaataaacaaaaaaaccccgccatatggcggggttttactattaaccgatggagccttccatttcgaacttgatcaaacggttcatttcaactgcgtattccatcggaagttcttttgtgaatggctcgatgaagcccataacgatcatttctgttgcttcttcttcagaaataccgcggctcatcaagtagaaaagctgttcttcagaaacttttgatactttcgcttcgtgctccaatgaaatgttgtcgttcaggatttcattgtaagggattgtatcagaagttgatttattatccataatgagcgtatcacactcgatgtttgaacgggcgccgtccgctttccgtccgaagtggacgataccgcggtatgttacttttccgccctgtttcgaaatcgattttgatacgattgtggatgacgtattcggtgcaaggtgaatcattttcgcacctgcgtcctgatgctgtcctttgcccgcaagagcgatagagagcgtcatgccgcgcgcgccttcacctttcagaatgacagccggatatttcatcgttaatttagaaccgatgtttccgtcaacccattccatcgtcgcgttttcttcacaaaccgtacgtttcgttactaagttgtaaacgttgttcgcccagttttgaattgttgtataacggcagtagccgccttttttgacgatgatttcaacaaccgcgctgtgaagcgagtttgttgtgtacacaggagccgtacagccctctacgtaatgaacgcttgcttcttcgtcaacgatgatcagcgtacgttcgaactgacccatgttttcagagttgatgcggaagtaagcttgaagcggtgtttcaaccttcacgcctttaggcacgtagatgaaagatccgccggaccaaacagctgagttcagcgccgcaaacttgttatcagtcggcggaatgactttcgcccagtgctcgcggaaaatgtcttcattttctttcagcgcgctgtctgtgtctttgaagacaatgccttgcgcttcaagatcttctttcatattgtggtacacaacttcggattcgtactgtgcagaaacaccggcaaggtatttttgctcagcttcaggaataccgagtttgtcaaatgtctgtttaatttcctcaggcacttcatcccaagaacgctctgaacgctcagacggctttacgtaatacgtaatttcgtcaaagtttaaagagtttaaatccccgccccactgcggcatcggcatgttgtagaaatgctcaagagatttcaggcggaaatcaagcatccattgaggctcttctttcatgcgtgaaatttcttctacgatttcttttgtcaatccgcgctctgaacggaaaatggaaacgtccttatcgtgaaaaccgtacttgtattcaccaatttcaggcatttttttagccatccattttcactccaatcttttaattgccgcctttttcgccagcgactcctttttcaagtgctttccatgaaagggtggcacatttaatccgggccgggaatttcgaaacgccttgaagggcttcaatatccccgagatctattgagtcgtcatactctttcccttgcatcatgtctgagaaaatcttagacatggaaagggcggtatcaatatcttttcctttaatggcctgcgtcatcatggaagctgaagccatggagatggaacagccttccccttcaaacttcgcttcctgaacggtatcgccgtcaagcttcattgtcagtctgatccggtcgccgcaagtcgggttgttcatatcgacgacgatgctgtcatccaaaacccctttgttgcgcggatttttgtaatgatccatgatcacttgtctgtataatgtatctaaatttgcattaaaagacatttgtaaagtactcctttgtcttttggagggcttccgcgagcttatcgatctcttcctctgtattatacagataaaaactcgctctcgcagtagcagatacatccagccatttcatgagcggctgggcgcaatgatggccggctctgaccgcaatgccctcagcatcgaggacagtcgcgacatcatgagggtgaacctcatcaagattaaatgtcacaagtcccgcccgctctttcggaccgtataccgtcacgccgtccagctgctcgaaacggtcaagcgcataggctgcaagcttatgctcatgccgggaaatctcgtcgagtccgatctcttcaagaaaatcaatcgcggctcccaatccgatcgcgcctgcgataatcggcgtgcctgcttcaaatttccacggaagctctttccaagttgattcataaagccctacaaagtcgatcatttcgccgccaaattcggccggttccatattctcaagcagttctttcttgccgtacagcacgccgattcccgtcgggccgcacattttatgggaagaaagcgcgaagaagtcgcaatccaggtcctgaacgtcaattttcatgtgcggtgtgctctgcgccccgtccaccacgatgacagcgccattgtcatgagcgattttggcgatctctttaatcgggttaatcgtgccgagcacgtttgacacatgagcgactgccacgatcttcgtatggcttgtgacagtctgccggacgtcgtccagcgaaagcgtgccgtcttcctgcatcgggatatattttaaagtcgcgccggttgcttttactgcctgctgccacggaatgatattcgcatgatgctccatttgggtgatgaccacttcatcaccgggttttaagctggcgcgggcatagctcagcgccaccatattcagtgaagttgtcgtgccttttgtgaaaatgacctcagccattgacttcgcattgataaacttacggactttttcacgcgcaccttcatagccgtctgtcgctctcgtgccaagagtatgaacgcctctgtggacattggaattgtatttgctgtaatactgatccactgcttcaatgacagcacgcggcttctgggaagtcgccgcgctgtcaaggtacacgaggtcatgtccgttcacttgctgatgaaggatcgggaactgttcacgaatatcggtgatattcattattttactttcctttcgatgacggagacgagctgtttcttaactccttcaatcggaagctcttttaccaccggagcaaggaatccgtaaatgactaagcgctccgcttcttctttcggaattccgcggctcattaagtagtaaagctggatcggatccacacggccgacagatgccgcatgtcctgcagttacatcgtcttcatcaattaagagaatcgggtttgcatctccgcgtgctttttcactcagcatcaggacgcgggattcctgttcagcgtttgctttagacgcgccgtgctcgattttgccgattccgttaaagatggaagatgcggcatctttcatgactccgtgcttcaggatatagccttcagaagccttaccgaagtggatgatctgcgtcgtaaagttttccgtctgttctcctcttccgacaactacggttttcgtatcgccgtatgtgccgtctccgtagaggtttgtcgtgttttcagaaatcgtgtcgccgtcgttcatcagtccgagcgcccactcgattttgctgtctcgtccgcgcgcggctccgcggcggttgacgtatgttgtgacacctgctgacaggttgtcaacggcgccgtacgtcacgctggcattatcacctgtgaccacttcactgataatgttgaataccgcttctttcggattcaccgtgctgatgtagttctcaacgtaagtgacggagctgtggtcttcagcgacgatcagcacgtggttgaacaatgccgtgtcattgctttcatgaacgtaaacggcctgaacaggcgtctccacctgaacgtttttaggaacataaaggaatgccccgccgttcattaatgccgcatgaagcgcagtcagtttatgctcgtcgacctttacgccgtctttcatgaagtatttctcaacgaggtcgctgtgctcacgggcagccgttaagatgtccgtgaaaataacgcctttgtctttcagttcttttgaaagagaaaggaaagcaggcgtttgatcacgctgcacatataacgttttatcttcgttttcgatatcgatcagcgcttttgcttcatcagctaaatcttctaaagaagcaagcggcgcgttttctactgtatgcttgttgaactttgtaaagttccaatttgtgatttttgttttatcaggcttaggcagcggcagatcttcagctttttcaagagcctgtaagcgcaggtttttcagccaggcaggttcttgatgcttttcggaaaagcctttgacatattcctgatctacggatagtttcgtttccaatgtcatgattatccccctaacgcttacgcttcttggcctacagtttcgtcttcaatgcctagttcctgtttaatccagtcataaccttccgcttcaaggcgctgtgcaagctccgcgccgccggatttcactacgcgtccttgcatcataacgtgaacgacatcaggcgtgatgtagttcagaaggcgctggtagtgagtgatcattaagcagccgaagttttcgctgcgcattttgttgattcctttagaaacgactttaagcgcatcgatatcaagacctgaatcgatctcgtcaagaatggcgattttcggctcgatcatcataagctgaaggatttcgttgcgttttttctccccgcctgagaaaccttcgttcaggtaacgctgcgccatttcagggtccatttcaaggaactccatgttttcgtccattttgcggatgaatttcataagagaaatttcatcgccttcttcacggcgtgcgttaatcgcagagcgaaggaaatcggcatttgtcacaccgctgatttcgcttgggtactgcatcgcaaggaaaagacccgcctgagcgcgctcgtccacttccatttccagtacatctttgccgtcaagcgtgatgcttccttttgtaacttcgtatttcgggtgtcccataatcgctgctgagagcgtggatttaccggtaccgttcggccccatgacagcgtggaattcgccgccttttatttcaaggtttacaccttttaagatctcttttccttcgatttcaacgtgaagatccttgatcgttaatgttgaagcagccatatctatacctccaaaatatataatcattattctcaatttattctcattctaattttataacaaatgaaaagtaaatacaactttttatattacccggaacattcctaaagtttatcaaagatcaaggcgtaattaaagctgtttgaaacagaaaaagggcggaaatccacccttttttactgaccgattttctcattaagctgcgctgcgaggaacttgcttttttgatattcaagctccctctgccgttcgacttccatcctttttgaaagacgccgtccgtattcctcgtagccgatgccgtgtgacttctgcatcgctttttccatttcaggcgtatagtcaaggtccagtctctcgtggctggtgcagataatgaatcaatcccttcatatatttgtttctattgtaacaatgatccgctgctccggccaaagagggtgtgcccctgaatcctttcgaatgtgccggaaaccggcgctcgctttatctgaaaaacggtattcacacgattgctcattctaatgcgtcgtatgtccgaattcctgaatacactgctgcacgagggtcactccctgactgagagccgcgccgcccccgaatgccgccgcgacgctgatgacctcaaggatgttttcttctgtggccccttggtcaaggcagcccttcgtatgataaatcatgcaaaattcatcttgagcgctgatgctgatgcccagagcgattaattgtttctctttttcagttaatgaatccgctgagaaacactgctcagtaaattcattaaacttccgccccatcatgggcattttttgctcgaatatgcctaaaccttctttatattgtttcaatgcgtcatgcacgctttttccgttatcctggtattgagccactgccattccctccaatcgttaaccttcctttttattatggacagttctccgattaatacccgaaaaaaaccccggatgattcatccggggttttcgctttattcagatacgggaagcacggctccgtcgtattttttctcaataaagtctttgattttcttagagtgaaggacttccataagcgctttgattttctctgatttttcgtcacctttgcgtacggcgatgatgtttgcgtacgggttgtttttcgttgattccacttgaatcgcatcttttaacggattcagtttgttttgaatcgcatagttgacgttaatgaagactgcatcgccttcttcttcattatatgctttcgccgttaattcaggggcgatttttttgaatgtcaggtttttcgggtttttcgtaatgtttttcgtagtcgcttcaatcgtttttaccttcggatcaagtgtgatcagtccggctttttcaagcatcgccagcatacggccttgttcagcgacattgttagtcatgatgatggtcgcgcctttaggcaggtctttcagtgatttgtattttttcgtgtaaactccgaacggctcaaggtgaacggctccggcattcacgagtttgtaatctttattttctttcatttcctgttcaaggtaaggaacgtgctggaagtagttcgcatccacttcattatcagctaacgctttgttgtacattttgtaatcgttcagcacttttacttttaatgtgtagcctttttccttcaagagcggttccgcttcttttaagatttcagcatgcggtgtttttgtcgcggcgacaacgatttcctttttattcgagccgtttgatccgcaggcggctaaaactcccgcgaacacaagcagcagcgcacttaatacaatctttttcaatgtaaatcctcccttatcttttgtctattatatttgtaattacatcaccgataatctgaatgataaagacgatgatgagtataaatactgtcgctacaaacgttacatccgtattattggactggtagccttctacatatgcaaggtttccgagtccgcctgaaccgatggcgccggcaatggcggtagatccgatcagggcgatggccgtcacggtgatgcctgaaattaacgcaggcattgattcaggaatcagcactttgaagataatcgtcgatgtctttgctcccattgatctggcagcttcgatgactcctttatcgacttcccggagcgcaatttccgcaagacgggcgtaaaacggcgcggagccgataatcagcgccggcaatgcggcattcggtcctaaaatcgatccgaccagaatcttagtaaagccgagaagcagaataattaaaataagaaacggaatagacctgaaaatattaacgaccgccgcaatcacggtgttaatgattttattttcccataagcttcccttgcccgttaaaaagagcagaagaccgagaatcgctccgatgataaatgaaaaaactaaagcgatgaccgtcatataaagggtctcatatgtggccgtccacagctcggttatatcaacgttcgggaaccatttttcaaacatttgtgatcacctctgcttctacctgtttgtctttgatgaaccggatcacgttttctacttctttttcctgaccgtcaatatgaatgaataatgaaccgtaagctccgtccttcgtctgtgaaattttcccctgcagaatattgacgtccacatcaaagtttcggatcatttccgtaatgaggggctgctcggcggcctgcccgacaaatgaaagctgaatcgttttccctgtcgctgtttcctgcagaaaatgctggatggtttctttcgtctcctccggttctgtcacctgctgaacgaaacgcttggtcatcggttcgcgcgggtttctgaaaacttggagtacttcgccttcttcaacgactttcccgttttccatgacggcgactctgttgcagatttttcggatgacgtgcatttcatgggtaatgagcacgatcgtcagaccgagtctgtcatttatatcggataaaagatccaaaattgaatcggtcgtctgcggatcgagcgctgatgtcgcttcatcgcacagaaggactttcggattattggcgagcgcccgggcgatgccgacacgctgcttttgaccgccgctcagctgcgacggataagatttttctttcccctctaatccgaccagtttaatcaattcatcagcgcggcggacccgttcgctttttttcacgccggcgatttccagcgggaacataatgttctcccggacggtgcgcgaccacaaaaggttaaaatgctggaagatcatgctgatttcctggcgcgcttttctcagcccgcggctgcttactttatttaattccgtccccgcgacttccacggttcccgacgtcggcttttcaaggccgttcaggagacggattaaggaacttttaccagctccgctatatcctataattccaaatatttcgccctttttgatatcaagagtgacatcttggacagcattgacatccccatgcttcgctttgtaaatttttgaaacattttgaagatggatcaaagcaatcacccgccttacactattctaagaaatcttccgggtttctccgcaaaagaaaagcctttctgcaaaaatgagcagaaaggcttattgaaaaaggcctttctctcatctttcaaagcagaccgctttgagtgaattggcaccatttcaacattgttgatggttgccgggcttcatagggcacttccctccacctctcttgataagagaaaacatatcgtattttcgtccggaaattcttactgtagaatagcacggcgaatgataaaaagtcaataaaataaatattggaagctattgtcacatagtagattggcagttacggccgtttactgatcgcctgaaaaaatccgtttgtcagccagaggatggcctccagcttcagcagggctctgaatgatcctttcactttgagttttccgctttggataagcttttgcaaagagacatcaccatgcaggagatggatgatttccgtctggtttccgtaaaaggtcaaattagatttctcctttgaagccgacgtttttctcatttctccctgtccgttaattgagaccgttaaggcttctgtttctccttggaatgtaatcagcagcgttgaggcgtttaatagcggtttcaaaaacagatgctgtccgtcattctctgaaacttctattttctccactcgtataacctcccgttttaatggccatacatacactttctctttttaacggacagaaccctttataaaccgcacgacattttcctgtaaatattgtcacatcgggaacgtttgcgatgttttttgtttaatcagctcatataaataggaaacggagcggaaggcgtatcctttctcaacaagctctccgcctttaaacagcaaaaagcacggaacgctttcaatctgataggctttggcgaatgcgggggaataattcacgttgtttttatagaaggcggcaccgggcagcatttcttcgacgacagtaagcattttggacgccagctggcatgtgccgcaaaacggggtgtacaaatacaggagataaacgtcatcctgaatcgattcgagttcattttcttggagttctttcatgattaccacctcaggtcgttctttttcaaaaatacagtgtcagcatcaaagccggctctgatcagcacagatgcgagatgatggcccgggcacgactcgacttgcctgtatgttctgtctatataaatatggcgcgcttcgggaagctcccgtttcagctgttttcttaatttttctccggagtcatctgcgtccgttaaaatatagacgtctctgtcaaacaggcggtccgccaactcttccagttcggtttggccgatcgtcccgtttgtacagacgatttccgcgggttcgatgagcacttccctgactttgattttatcagattttccttctacgataatgaccttttcatctccgttgtacataagcgcgtcacctgccgattgttttagcgtcagattgaaaaagaaggcagtgaaattcaccgccaactgttaacaccagccattctcataatcgcaatcgacatatttcggatcgctgccgtttatgacatcggctgttttataaaatttttgattttcaaatgaaaagccctgtttgagctcgtactggtccatgcctgtcatctcgccgatggcttcattttcatgaaacaaggaaaaccggccgttttgaaagcggcccgtgacgttctccgtcacatcgaccttttgtttatcaaaagccattttagacacctcccgttacagatagagtgtccaaatggcccctttgctatccgatcagtcttcctgtgtcatttcgtcatattgctcagaagtcatgaggttttcgatttcttcagcatcagccggttccacgacgatcatccacgctttttcatacggagactcgtttacgaattcaggactgtcatcaaggtcttcgttcacttccgtcaccgttccgttaatcggtgcgtacagttcggatacggttttgacggattccacgctgccgaatggctcgtccgctttaatttcggcgccgacttccggaagctcgacaaatacgatgtcgccaagttcggcttgcgcgaaatgtgtaatcccgatacgggcttttccgtcctcaactttgacccattcgtgctctttggaataacgcatatctttcggtgtgctcatctaaatccctccatttttttcttataataagaagataccataattctttgaacctggcattacatccaatatttttcgaattggtcttctttaaagccgacagtgactttttcgccgtctgtcgtaatcgggcgtttcaggagcataccgtctgatgccagaagttcgagctgttcatcctctgacatatggtacagtttttcctttaagttcagctcgcggtatttcattccgctcgtgttgaaaaactttttgagctcaagaccgctcttttcatagaggtctttaatttcttctttcgacggagtttcctccgcgatatgtatttcgtttatttccttaccgcggtcttccagccattttttcgcattacggcacgttccgcatttagggtaccagtaaaaatttaacgacatcttcttcaccccttgtaaatgatcgtcgttattttaacacaatcacttgtaaaaacctataacgttgcttcatgaaaaagcgcccctgatgaaggagcgctttcagcatgtgatcagactgtatatttttcttcacggaagacggctgctgccgcttcacgttttttctgaatgaggtttttcggcgtcaggcgcgtcagtttgcgcagcacggaaagcatcatgcggagggaatctccttcctccatggcgatcagtgattctttggcgtgcgcttcaatgttctgaagggcttcctgggcaaagatttccgtatataacagcttctgcgcggctttttcggcaccgtccgccgcaattgctttttccgttctgaggacggcagattccaaagcatacagcgcgctgacaatatcggcaatgttcaccatgatttcctgctcgccttcaatctctttgccgtatttctgcgccgcgagacccgctgtcaagagggcgatctttttcgcctgtctgacaatgtatttttcctgttcaagaggttctgagcccggctcttcaggcatcagcatcatgagttcttcttggagcgcttttgctttttcaaagagcggcagctgaccttttacggcttttttcagaaacgtgctcgttacgatcaggcggttgatttcatttgtgccttcaaaaatcctgttgattcttgagtcgcgataggcgcgctccacttcatattcctgcataaatccgtaaccgccgtgaatttgaaccccttcgtcggcaatgtaatcaagcgtttcagaaccgcacattttgttgagcgagcattcaatcgcgtactcggcgatggacttcgcgacttcgcgtccgtctttttgctcctcttccgtcagtctgctcatattatcttcgaataagcccactgttctgtatacagagctctccatggcgtaaagccgcgctgacatcgtcgcaagcttttcctgagtgagcgtgaagcttgagatcggcgttttaaattgccggcgctggtttgcataagcggcagacagctcaatcacccgttttgaagcgccgattgtgccgacggcaagcttgtagcgcccgatattcaggatattaaaggcgatgacatggccttttccgatttcgccgagaagattttctttcgggacttccgcctgatctaaaatcagcgttcttgtcgatgaacccttaatccccatttttttctcttccggtcccgttgatacgcccggatagttcttttctacgataaatgcggaaaacttatctccgtccactttagcgtagacgacaaagacatctgcaaaggcggagtttgtaatccattgcttttctccgttaagaatatagtgtgtgcccgcttcattcaaaacagccgtcgttttcgcgccgagggcatctgaacctgaaccgggctcagttaaggcgtatgccgcgattctttgtcctgaagccaagtccggcaaataggtttttttctgttcttccgttccgaagaacacgatcggcaatgaaccgatcccgacgtgagcgccgtaagatagcgaaaagctgccggcacgtgaaaacttttccgtaatgaaggctgaactgattttatccaggccgattccgccgtactcttcaggcacgtctgctccgaggaggccgagatctccggcttttctcagcagtctgaccgaatgctcaaactgatggttttcaatttcatcgatataaggaagcacatcgtttacgacatagtcttctgtcgttttgccgatcattttatgttcgtctgtaaagtcctccggagtgaatatttgatcatatcccgtctcttcaatcagaaagctgccgccttttttgacgttgaccgtttcctgtttcatgttcatttccccctttttttaaatgagttcaaatacgccggcagcgcccatgccgcctccgatgcacatcgtcacaacgccgaattgctcgtttctccgtttcatttcatgaatgagtgacagggtcagcttcgtccccgtgcagccgagcggatgtccgagcgcgatggcgcctccgttgacgttcaccttttcttcatctatcccgagcgatctgatcacttgaatggcctgtgaagcaaaggcctcattcaattcaaaaagcccgatatcctgtaattcgagtccggcaagcttgagcgcccgcggaatggcttcaatcggaccgatccccattacttcaggcggaacgccgcctacggcaaaggaacggaatttgacaagcggggccaatccaagcgacgatgctttttcgcgatccatcagcatgacagccgccgcgccgtcacttgtttgtgaagagttcccggccgtcacggttcccgtttttgaaaaagccgggcggagcttcgccaagacgtcagccgacgtgccgggacgaacgccttcatcctgagaaaaggtaaattgttttttccgcggcttatggtcatcaccgacttctgtcagcgatacttcaaccggcacgatttcgtcattgaatttcccttccttaagggcttttgcggcattctgatggctgcggactgcaaatgcatcctggtcttctctggatactccgtacgtttcggcgacctgctccgccgtatgccccatgctcatgtaatactcaggcgcatgctccgccaaagcgatattcggccgtgtcacatgccccatcatcggaacttgcgacatggattccgcaccgcccgcaatgacggtatcacccgcgccgatcataattttttcagcaccgtaagcgatggattggagcccggaagagcagtagcggttcaccgtaatggccggcaccgtatgaggaagccccgccagcgcaccgatattccgagccatatttaatccttgttcggcttcaggtgttgcacatccgataattaagtcatcgatatttccttcatagccgcctgcccgtttcagcgtttcttttacacaaagcgcgcctaaatcatcaggacgaacggctgcaagcgatccttttttcgctttaccgaccggggttctcgcaccggccacaatgactgcttctctcataaacaccctcctagttccgtaaaggtttgcctttgacgagcatatgctgcattctcgcttgagatttcgcctcgccagcgaggcttaaaaaggcttctctttcaatctcgagtaaatattcttctgaaacctccgtgccgaacgggactcttccgccggcaatgacatgggccagcttcttcgcaatcttcatatcgtgatcggataaataacccgaccgtctcatttggtctgctccgagcagtaatgccgcacagccggtttctccggtgactttcacttttttgcgggcaggcggacggtatccgctgtcatataaggaagcagccagctgtttcgcatcgtgcagcaggtgatcctgattcatgctgatacggtctgccgcggacaaaatcttcatgtcacgggcttcgtgtgccgaaccggacaccttggcaagcgcgattgtttcgaaggttttaatcgctgcgtccatgagttcacttccgccgtccagataattcatgtacagctctttgtttcctccgccgcccggaataagaccgacgccggtttcaacgagacccatatacgattcgctcgccgcctgaacgcgtgccgccgggagacagacttccgtgccgccgccgagtgtcatcccgaatggcgccgctacaaccggtttagcgctgtatttgatgttcagcatcgtctgctgaaaacggcggatgacaaaatcgacttccatgaagttatcatcctgggcttccattaaaatcatcgcaaggtttgctcccgcgcagaaatgtctgccttggtttccgatgacaagacctttataattccgctccgtttcctcaagcgcattgtcaatcatctgaataatgtctaagccgatcgcgttgcttttcgtatgaaattccagcagcgcgacatcatcgccgagatcaaccagacttgcgccgctgtttttagtgataacgccttttgtttcttttaacgtctgcaggctgatccgtttcggattttctttcacagccctgtattggccgtctgaataataaaattgtgttccgttttccttcatataaaatgtttcatgaccctgatcaagcatttctttcacccagccggggagtgctgcgccttcttcttcgagccgctccgctgattttctgacgccgatggcatcccacatctcaaacggtccgagctcccatccgaagccccatttcatggcgtcatcaattgcttttatatcatcagcgatctcacctaaaagccgggctgagtataagagtgtttgcgatgtgatattccaaagcaggcgtccggcgcggtcatcggaatatacaagcgctttcattttgcctttggcaccctttgcctgtttggcggcttctaaagcgggcgtcttcattttcgagcgctcaccgtatgtcatggtcagcggatcgagttcatatattgttttaccttcttttttgtaaaaaccttggcctgatttgctgcccagccaattgtttttcagcatgtcattcataaattcaggaagcttaaacatgtctttttcagcgccgtcggctttatcatatacgttttttgccacatgagcgaaagtatcaagccccacaacgtcaagggttctgaaggtcgcgcttttcggtctgccgatcaaaggtccggtcaccgtgtccacctcgccgatgcggcagccggaagaaagcatttctcttaccgtgaccagcaggccgtacgtaccgatgcggttggcgataaagtttggcgtgtcttttgcgatgacgacacctttcccaagcgtgttttctgcaaatgaagtcataaactccagcacgtcaggatctgtttcctgaatcggaatgatttccagaagcttcaagtagcgggccggattaaagaaatgggttcctaagaaatgagccttaaaatcggcagatcggccttccgccatttttgtgacggagataccggacgtattgctcgacacgatgcttcccggtttccggtattcatcaacgagtgagaaaatctgtttttttacgtcaaggttttcgacgacgacttcaataatccaatcagcatccttcaattgagctgcgtcatcttccaaattccccgccgttatatagtcgagattggcagccgaagtcagcggcgccggtttttgcttcagcagcttttgcatggccgatcggctcagtctgctgcggacctccgggctttctaatgtcagcccttttttcatctcatcctttgtcagctcgtttggcacaatatcaagcagcaggacgggaattccgatgttagccaagtgcgcggcaattccggaccccatgacgcctgatccgagaacggctgctttctttataaacttgtgcatgagtcatcccccttgaactttgaatgaatagtcattcattttttcggcaaaaaaaatgaaacccttttcttctttcatcttaaaagattttcaggatgacttcaatagcaaatatggaatttttttaaatttttcggcttccgcatgttccatggcgcgggcgggaaacttaaacccggaggtgaagggaatggtgcgagggagaaaagatccgtcttctgccgcagtgagcgcggccagcatgaaaggaaatgcgggaccgaagcaaaaatacggcggcggcaaacggacgagccaaaatcagcaatataaaaaagacaacatggaataacatactgcggctgctttttggagcagccgttattttttgaagattcctttcagcacaaacgccgcatttgccgggcgctcggcaattcttctcatcaggtacccgtaccaatcggttccgtacgggacatacaccctcatcctgtatccttcttcggcaagctccttctggcgctccgttctgatgccgtacagcatttggaattcaaactgctcccggggaatctgatgctcgctgatgagtgttttcgtatacgaaataatatcgtcatcatgtgtcgccaccgccgtttcatagccgctcaaaagctgcagcttaatcagctgctgaaaatgaagatcggttgcttttttatcagggaacgcaacggccgccgattctttataagcgccttttacaagcctgagccgcggcttatatggcatcagaccgctgatgtcttcagctgcgcggtataaataagcctgaatgacggtgccgagcatcggaaaatccggcttgcaccgcttatacagctcaagcgtacggccgcatcttgaatagtcctccatatcaatcgttacaggcacgccgcgttcttttgcctccgtcaatatgtctctgacatgctgttccgcgagttcctcggaaatatccagaccgatggatgttaatttcagcgacagctcacaatccagttgattctcggcaatcgccctgattgcttttttacattcttccgccgtctttttcgcatccttctctgaacccgcatattcacctagataatcaatcgaagccgacagccctttttggttcagccgctttaccgttttcacagcttccgtgagcgtttcccctgcaacgaaccttcccgcgccgaagcggattccgtaagcctgggcgaattttgtaagcattttatttttcgacaaaaataaacatatgctccgcagcaaggatgaactccctcctttttcttttattcgtgtatgaatttccgatcgcagagaaagctaaaacacaaaagccatgcagattgccaagatatcattcatatatccatacagactctgatgtcaaagcaatgtattatattatcaagatattcaaacggttttaatgagtcacaaaaaggatcaataaaaatcactacttcttcaattgagttttcgagctataattccgcttcttcgttacatttcgcccaaaaaaacttataatttatatttctttatccccttataatttgaaaatattccttaaaagataattgatttataatttacaatggcttatatttaaaattgataattcagtttattgaacgtatctattaagaaggaaaagcagaatttcaaaatgataattctgctgaatttatctttgcctcacaaacatacctccaaagcattattatttctttctaatagctttacgatccttcatctttaaagatggcttctcttccctaacggaatttaaagaagggacctgcctgagttatccattcaccttattttgaagaatcactaagctcgaaacatatgaaaagagggaaccttcaattggattcaacaggaaaatctaaacgtacacttttattaattggacttattatagctatgtttttttctgctctggacggaacaatcgtaggaacggttatgcctaagattgtaggagatctcggcggcctgagcatgatgacttggctgactacggcctacctattaacatctacctccatcgttccgatcgctggaaaacttgcagatctattagggcgccgggcagtatatgtggccgggctgattatattcatgattggctcttcactgtgcggcctggctgataacatgaaagaattaattgtgtttcgaggtttacaaggtcttggcggaggcattatgatgccgatggctatgattgtcattggagatttattcacaggcaaacagcgtgccagatttcaaggcgtatttggcggtatttacgctcttgcttctgtaatcggtccgcaaattgggggatggattgtagattctttcagctggcattgggtattttttatcaatttacccgtgggaatggtagctgtgttctttattgcgatgggattgcaggccagaaaatacacgggtccgattcattttgacttcatcgggatgtttacaatgattacgggtgtagtctgtttgctgcttacactcagtttcggcggaaaagaatttgactggttatcatggcagacattttgtctgttagctttggccactataagtattattagttttgtatttgcagaaaaaaaagctgcagaaccaattctgcctatacatcttctaaaaagcagaacttttatcttcttaaatttaatagggttctttatgagtattgggatgtttgcagcaatcaccttcgtccctttcttcatgcaaggaataatcggcatgagtgcatcagagtccgggacaatcatgatgccgatgatggtcgcaatgattatctccagtattataggcgggcagctggtctttaaaatcggcattaaagcgcagattatcacggggatggcaatcatatcctttgcctattttttattatccacattagaagctgacaccagcaaattaactgcaactacttatgtagctatcatcggcttcggtatgggccttgttatgcccattattactctggcacttcaagagagtttctctaaagaaacgctcggcgtggttacttcgtcaagccaatttttccgctctatcggaggtacgtttggaattacgattctgggagcagtgatgaatgccaagtcaggaaatatattaaccgataaattagttccttttttagacaattttccaaaacaagaaaacgcattagcagctcatctcaaagacttgatcagcagcaatcctcaagtcctgctacagaggctattcagttctggttcattcgaacaatttccgcattctatagcaaagcacatcataccgataatgaagacagcgttaatggactctcttcgcagtgtatttttcgcagggcttatactattaattgccggagtattttctgcttttcttttaccaaaaataaaaataactgaaagaaaagccggcactgatctagacaataaaccggcagctgaagtccaatcctagtgccgctgctgactttcgcatatatcgaactgttaacatgaacagacattatccgaaggttttttcttctgatagtgtctttttttattgtaaatattgatgtctctcctgcaaatcgtggttattttaatttatctgtatgaaatcccgatcgcagagaaagctaaaaagaacagaattgaaggaggcgtttatatgaacaaccaagagcagcacggaaacttgccgcctgccgtcatctcaacgaaagaccatttgtatcttgaggacatgctgaactggaatctgcttgccatgaaaaaagcgcattttatggcggaacactgccagaatcagacgttaaaacaagagcttgatcagatcggccggatgcatgagaagcattatcagcacatattgggccgcttgaaccccggtcaaggcggacagacaacaacaggctatatgcaataggaggacaatacatggaacagcaaaatcaaaaaatcacgaatccgcaaacgcccgtgcccaatacggcgcaaatgaatgacagagacttggtcaatgagctgctgacgacggaaaaatacatcacggcttcatattgcacagccctgcacgagttcagccacgagtctctttatcaagatattcaggcgattttcgatgagtcacaaaaagcgcaaagaagattatacgatgtgatgtttcaaaatggctggtattccattgaagccgccgatacccaaaagcttcagcaatcgtatcagaagttccggcagaccattcagcagcagtctccctaccagcagtaaaatgaaaaaggatttgatgttttcgccaagcatcagtcctttttttatttttgcacaaaaagattgacttatcattaatccttatttatatttaactaatgttaattattttctcaaggaacaagatgaggaggagttatgaaaaacgcggatcaatatgtgtctgacatccagaaatctcttcagacgctgctgcaaaacatacagcctgaaatggtggaaagcatggcaaaacacgaggtgacgcctgcccaattatttgttttagccagcctgaaaaaacacgggagctgcaaagtttccgaaattgcggaacgcatggaggtaaagccgagcgcggttacgctgatggccgaccgcctcgaacaaaaaggacttatcgtccgcaaacataaccagcaggacagacgcgtcatcgacatcagcctcaccaaaaaaggcgaaacaaaattcgaagatgttgtggaaggacggaaagcgatactggcgcgtaacctgtccgttctgactgacgatgaactgattcagtccgtgaacatcatccgcaaagtagcggaagccgccgagaaatacgcggctgatcaaaaagaaaacgaatagaaagaggagctgccgaaacatgagcattgaaaagaaagatccaaaacgcacattattaataacgggcttaatcatcgccatgtttttctcagcccttgacggcaccatcgtaggaacggcgattcctaaaatcgtgggtgacctcgggggattaagcatgatgacgtggctgaccacggcatatcttttaacttcgacgacgatcgttccgattgcggggaaacttgcagatttattggggcgccgcgtcgtctatgtgtcaggtttattgatttttatgggagcttccgcactgtgcggaatggccagcaacatgacggaactgattattttccgcggacttcagggaatcggcggcggtgtcatgatgccgatggccatgatcgtcattggggatttgttcacagggaaacagcgtgccaagttccaagggcttttcggagcgatttacggccttgcttccgttatcggcccgcaaatcgggggctggattgttgactcattaaattggaaatgggttttctatatcaacctgcctgtcggaattttagccgtgatctttatcgcaagaggacttcaaggcagaaaacagactgggccgattaactttgacatcgccggcattttcacaatgattgtcggaatcgtcagcctccttctcgcgctcagcttcggaggaaaagattacgcatggggctcttggcagattctcggtctctttgcgcttgcgcttgccgggattgtcggattcattttcgctgaaatcaaagcaaaagaaccgattctgccgatgtacctgtttaaaaacagaacgtttaccgtactgaatctgatcgggtttttcatgagtatcggcatgttcggcgccgttacgttcgttcctttctttatgcagggaattatcggagtcagcgccaccgcgtcaggcacgattatgacgccgatgatggtatctatgattatcacaagtattatcggaggccagctggtttataagatcggtattaaaccgcaaatcatgatcggcatgctgatcatggccgtcggcttcttcttattaacgaccttacagctggatacaagcaagctcgcggctacgtgctatatggcagtgatcggtctgggaatggggctcgtcatgccgcttctcacactcgctctgcaagaaacgttttcaaaagaagagctgggcgttgtgacttcatcaagccaatttttccggatgatcgggggaacgttcggcattacggtgctcggcgctgtcatgaatgccagatcaggaagccttttaaccgacagactggtgccttacttagactcactcccgaaacaggcaagtgcctttgccgcccagtttaaaggtatgattgacaaaaatcctgaagggctgcttcaatccttgttcagtcaggaatcgattaagcagatcccggccgcattttcttcccatatcgtgccggttttgaaaacgtcactgatggattcgcttcacagcgtgtttttcacaggcctggcctttatcgctgccggattgatcctcacgctgtttgttaaatcaattaagctgacaaacaaaaagacaggcaaacaagaagaaaaggcgaaagccgtttaacaaagaaaaatcccgcggatgccgcgggatttttttatatcatctgggcctctccgtttccgaatgaccagtcttccgcctcattggaaatcgggggtgaaaattatttaataaaccttaaacatttcatagttatctttatagtacgacaaaataaagtcacgaaaatttcttaccgaagaagataacagcttatgtttcatccaagataagccgactggatatgaagcagagtgatcagtcacttttataaaattcagccccaatgttctgcaaaccgaaataggaagcaacgccaccccctgatccagctttataatctcggccagtaaatgagaatccgcctcaaatgcaatatttggggtgaaaccggctttttcacaaagcgaggctgtaaaaccgctatactcttcattattagcaagggtaataaatggttcatcggcgacaagacgtaaagaaatttcggttttacccgtaaatcggtggtttgagggcaaagccagaacaatatcttcatttaccagcatacaactttctatctcttcatcttgaataggatgacctgttattcctaaatcaatgtcccctttttttaaacttgttaggatcccgcttttaactccgatggcttggagaatttttgattgaggggagcggttgatatattcactcatcagtcctgcaaggaatctcggattagaaatagatattctgatggtgtcagacatttgatgttcctccaattgaatttccgtttgtgcattttcaatctcagtaaaaatcctgtttacatgttttaaaagaattttccctgatgaactcagcttaatatttctgccttttctctcaaacaaagctgttcccagttcattctcaagtctttttatagtgagacttaaagaaggctgggcaatctttaattgttctgctgctttagaaatatgctcagtataggcaactgtctgaaagtattttagctgcagcaattccatctgtctgcatcccccttatttatttcaataaatatatatataccttattatgtattagattaaatgtaaatgcggatgtaagataatagcatagttaaagaaaaggaaagggtgtcatgcaatgaaaattgatgtgaaagatatagcaaaaaatttaaatacaccgctaacggctcctgcttatcctatcccaaattataaatttgttaaccgtgaatatttaaatattatttaccgaacggatgaaaaagctttgcgtgcggcagtgccggaacctcttgaaattactgaacctttagtgaaattcgaagtgatgcggatgcccgatgtttccggacttggtgcctatacagaggcaggacaagtcatccctgtcagctttaatggtgaagaaggagattatgtacactctatgtatgtagacaatttcccggctattgcaagcggacgggaacttactgcatatccaaagaaattgggcgcccctaagctgtatatagactctgatactctcgttggcacattagattatggcagtcttcgtgtggcagctgcgactatgggatataaacatttcgaaatggacaaggaaaaagcgaaaagggaaatttgccgacctaattttatggttaagattgctactgattacaatggtgatttaagggtttgcgatttggtgcgcacgcaaataacgaatatagaagttaaaggtgcctggtctggaccggcgcggcttcaattatttgaacatgctctggcgcctcttgcagatttgcctgtattagaagtcgtttcagcatctcatattattacggatttaaccttaaatgcagcacagccggtttataactacttagaggaaaaataaggagacgtttacaatgagaattgcaattttaggagcaggttctttaggaaccatagttggagcatatctgtctgctggcggaatggatgtcgaattaattgattcatacaaagaacatgtagatactttaaatcaaataggtgctaaagtagttggtacaacggcatttcaggcaaaggtaaaagccattacccctgaaaacaagtcaggcaagtatgatttcatattgctcctgacgaaacaattatataatgactccattcttaaagagttactgccttttttaaaggatgatagtgtagtatgttccttgcaaaacggtatacctgaacagaaagttgcttcgatcgttggtggtgaacgtgttattgcaggttctgttgaatttggtgctacgtttattgaaccaggcgtatccagacttacaactgagtatactcaatttaaagagtacgcttttcaaattggagaattaaatggtgaaacaacagaaagaatccagcgtattaaatcggttttagaccttatcggcggaacacatatttccgataatttagttggaacgaagtggtcaaaattacttatcaataatgcattcagtggtttatcggcagcattaaacggagaatacggtgatattcttgaccatgaaatcggcattgtcagcgcagttcatatcgcagatgagacgattaaggttggacacgccaatggtgtcacatttgcgaaaatgggcggccttgatttagaatctttggaattaaaaagtgaaaatgagattcctgaacgtattcaaacatttagggcagccatggaaccatccaggcttttaagagcaagtatgcttcaggatcttgagaaaaaacgcaaaactgaaattgattatattaatggagttattcccaaaatggcagaaggtactggaatttcaacaccttttaatgatttggttgtagcacaagtcaaatgtgccgaggaatctcaaacagtgcccaattttgatacaaatataaaagcatttgaagagttattacgtatccgaaaggaaatgtgatatataggaaagagtaagggattgctgcggcggtccttttttcttggttcagcaagtaaacaaacgggtgtgttagttacattaaagttcttcgttatgaattgaacggcgcctttattgattccttttcagcaaaaaaagcttccggcacctctctttgatgccgaaagctttttattgtttttttctgtgagcttcattgagctgtttaatgtgctgtatcgcagctttgatgccctctttggcgtccgggtaggattgattccaatgtttgacgagcggcggcatgctttttgcgatatgtgtatacaaaatccactgcctgacttcttcctttacatccgggtttgtttcgccaagcaatagttcagtgtatttctcaagcaggccgtccagctgctgctgcagtttttcttccataccgtttccttccctttttcatgattatgacaatcgggcggtgagggccgcttcctgcacgatacatctgccgcgtccgtgcggaatgcaaagcggcgtgccgaacagcggatcttgcgttacctgacagttcattgcaaagacctgctgtacaagctcgcaagtgatgacttcttcgggacggccctctgcgtaaatctgtttatcctttatggcgaccagataatgggcataacggcatgccagattgagatcgtgcagcaccatgacgattgtgcgtttttctttttcatttaattcaaacagcaaatcaagaatttcaatttgatgcgtcatgtcgagataagtcgtcggctcgtcaagcagaatgatatccgtatcctgagcgagtgtcatcgcaatccatgcacgctggcgctgtccgcctgacaaggaatccacaggacggtcggccatttcctcaagcttcgtcgcttttagcgcttttgtgactgcgtcttcgtcctctttggaccattgcttcagccagctttgataagggtatcttccctgcttcacaagctgatgcaccgtcaggccttcgggagctgacggactctgcggcaaaatagcgagctctcttgccacttccttcgtcggaagcttagcgatggcttttccttctaaaagcacagaaccgcccctcggtttcatcagccgggccaatgaacgtaaaagcgtcgattttccgcagccgttgcttccgatcaatacagtgatttcgccttttggaatcgcgacatccaattcgtcaatgataacagtctctccgtaccctaagctcagcgtctctgtagaaattgcactcataccgctaaccgctccttttttgagtttcccaacactatgtatataaacaaattgcctaaacattcaacgtgagatcatgattatattgtaacagaaattaatgactctgaatatcattatcaattagttttgggtaaaaaagcagcgggcggcggttatttttttatttccgtcattactccatcgttctttttcagttttagataaaaatggtcatagcggctgtccaaattaaaagccgaaagcacctcccggacgacctcgctttcctgcatccggccgtttacggcaagttctccgaggatcatcttcatttcatcaagcgcttcctcgccctctctgtgaacccctgagagcttgtcccggatgtccgccttttcatgaccgctttttctttcatacaaaccttcatagcggttatgctctccggctccgtagctgacgcgcagggaaaagctgctgtaaggaaccggcttctcggatgacacaggtgtgctgtcttgttccgcttcccgtttttcttcattcaatcggcagccggcaatcagcatcagcgtaagacataaaacgcccgccgttctgatccatttcatgcgattcactcccattccattccgatcgtttttaggtatttccaagggaggcggctgtcattcacggaacaaaaaagaaccggagcggtaacagctccggccggttcatctccagattatcattcagtcagctctaaaaattcctgcacatcctgtacggcaaggcggaccgcgtcttcccaaaacgaccgttccgtgagatccgctccaaggtgcttcatcgccaaatcctcaacggtcatcgaagccgtgtcacacaaaagcgcgatatatttttcttcaaaatccgctttttcccgaagagctcttgcatatattccaagcgaaaataaataaccgaacgtgtacgggaaattgtagaacggcactcccgtaatatgaaaatgcagttttgacgcccagaaatgagggtggtattcccctaatgaatcgcaaaatgcttctttctgcgccgcttccatcagttcattcagtttctcagccggaacgacgccctgcttgcgctcttcataaaaacgcgtttcaaataaaaatctcgcatgaatattcataaacatggctacgcttctttgaattttatcttcaagcaagaacaccttttcatcctttgtctccgcttgtttcaaagcggcgtcggcgacgatcatttccgcaaaggtcgaggctgtttcagccacattcatagcgtaggctctgttcagctgccgcacttggagcatggcctcctgatgaaacgcgtgaccgagctcatgcgccagcgtcgatacgttcgaagcgcttccggaaaacgtcataaaaatccgggattctccgctgtcgggaaagctggtgcagaaaccgccgacccgtttgccgctgcggtcttccgcttctatccaccgatcgcggaacgctttttccgtgaatgcggacagctttttgccaaacgtcgaaaattggctgacgatcagattagccgcttcatcatatgtgtattctttcgaagcctcgccgatcggcgcgcccacatcataccagttcagccgctcaagccctaaaagagacgcctttcgattcaggtattcggcaaaaggctttttatgatcggtaatgacctgccacatgacatccagcgtttcttttttcatccgattgatcgcaagcggctcttccaaagcgcttttccagccccgcgctttatagatttccgtgcggaagccggccagatggttcagcgtgctgctgaaaagctcctcttctcctttccaggcttcattaagctctttgaacacttgacgtctgatgcggcgatccgggtgcgccatcatattttccgcttggccgaccgacagctctttatcctcaaacggaatcttcattctgccgacagccgcattatacaggtcgccccatgcgtgatagccgtcaacggccaggccttcaatcagcctttcttctgaagcgctgagcttctctctgacccggtctcttctctcatttaaaacatatgtgagatcctgaagttccggtttttgcaggagctcctcccagacccgctcgtcaatccgggcaagtgtatcgtcaagggtgaccagagcggatttaaaatcactgctcagctgattgatccgcgctctccattcattcgctttctgatcatgagtgttctgagcctgaagacagccgacgaacgctcccgcctgcctgatcatgatcgctgaccgttcaaacctatcaatcagattgatcagctcccggctttcatccgcgtgcgtcggaactgtaaatgcttcaaccgcatgttgaaaagcgcttagatgctttttgagctcttgtatgtattgctgaaactcttccgaccggctcccgccctcaaaaatggagtttaaatcccatgtttccttcaatccctctaatgccatcttttctttacccctttctatccgaagctgactccattataaaacaattctgacatatttccgaacgatttctccttctttccgcgagatgttatacactatgagataagaacaaacgacaaacggggaggattataagatgaacagaaaagttgccattgtaaccggtgcgacgagcggattcgggatgctgacagcgctgaagctcgcccggtcttatcacgtcatcgcaacagccagacagccggagaaagctgtaatactgaaagaggccgccgctcaagcgggtgcatccgcatatattacggtcgtttctttagatgtgacaaatgagcagtcggtgtctgacttcgggaacaccatcagcggtttcggaccgattgagctgcttgtcaataacgccggcactgcgtacggagggtttattgaagatgtgctgatggaacattacagacagcagtatgaaacaaatgtattcggtctgattcacgtcacaaaaaccgtgctgccttatatgcggaaacatggcggggcgaaaatcttcaatatcagcagtatcagcggactgaccggtttcccggctctatctccgtatgtctcttccaagttcgcggttgaagggtttacagagtgtctgcgcctcgagcttctgcctttaggaattgatgccgctttaatagaaccgggctcctataaaacgtctatttgggagacgtctctctccagccatattacggcgcccggcaaagactcgccttattatcgcttttatcagccccttgaagcttacttcaaagccaacgcatccaaaagcggcgatcctgatgacgtagcggagctgatttatcaattggcacaaaggaaacggctgaagaaactgcggtatccgatcggcaggggcgttaagctgacattggctttccgctcactctttccgtggtccgcttgggaatcgattataaagaaaaagctgttcacttaaactaaattataataattataatttagtattgatttttatttgatacgtgatataattaaattaacagatcacagggaggacgatgaatatgaatacacaaaacgcgaaaaaaactgaaactcttgttgagaaatcaatgaacacacaattatcaaactggtttatcctttactctaaactgcaccgcttccattggtatgtaaaaggccctcacttctttacgcttcatgaaaaatttgaagaactgtataacgaagcagcggaaacggcggacgccatcgcagagcgtcttctggccatcggcggacagcctgcggcgactttgcacacttaccttgaacaagcttccattacggatgaaggtcaggaaaaaacggcttctgaaatggtgaaatcactggttcaagactataaacaaatcagccgcgaatcaaaatttgtcatcggcatcgcagaggaacaaaatgacccgtcaactgccgacctgtttgtcggattagttgaagaagcggacaagcatgtgtggatgctgtcagcctacttgggagaatgacgaaaaaagctgaacctcagttgaaggttcagctttttttatgcgctcagcttgcgctttcagtttgtttcgttaatgtgacgttcagcgtctttttgcttccgcttctgagcacttgaacagtcgttttatcgccgattttcagctggttatataagatctgtctgatatcggcgctgctgtcgacatctttgccgttcagttgtacaatgacgtcatttgatttgatgcccgctttcgcagccggtgagccggattgcacttcttttacgtaaacacccttagacagctggtcgccgaacagtccgagcgtgttttcctgataggtttccggaacttgcgccatgtcaatcatctgcacacctaaaaacgggcgctcgacttttccttttgcaagcagctggtcgactatcggttctacatcattgctcggaatggcaaagccgagcgactccacgccgttttcactgactttcatgctgttgatcccgatgacctggccgcttgagttgattaacgggccgccgctgtttccggggttaatcgccgcatccgtctgaatcacgttcatttccaccgtgccttgggatgtatcggcgtccaccgttctgttcagcccgctgatgacaccttgtgtgacggtgccggaaaactgctggccgagcgggttgccgatggcaatcactttatcggcaatgcggagcttggaggaatccccgaagctggccgcttttttgacattggacgagctgatttccaatacagccaagtcactgatggcatcctttccgacaagctttgccgtttcggttttcccattgtaaagagtgaccgacagtttgttcgccccttctacgacatgattgtttgtaatgatgtacgctttttcgccgtcttttttgaagatgacgcctgaccccgtgccgctttccgtttcagagcttgaaccgccgtcaagtccgaactggctgctttgcgaagcttggtagttggacactccgacaatcgcgggctccaattcttccaccatatccgctacgcttgaggtatttttcaaaggcgttgacgtaaaattcgaagactgaacttgtttcgtatcagaaacggcttctgtcttatgctgctcacccggcaggttcggcacaatgccaagcacgaggcctccgccgataatgccgcctaaaatcgggctcagccaagcggctctccgttttttttcttttttcacggcagccgttttttcaaattccgtaccggcagccgtctcgttttccggttctttcgagacggtcccttcaagcagctcgggctcctgatggctgatctgctgctgttcatttctgttttgttccgtatgtgaaagatctgactgatcgcggcttctgccgtcatctcgatgatcgttcatattcacgcacactccttcagcatgttttcattctatcgattacatattcatcgcatgtacaagttctattgtcccaataataaggagaaaagcaaagctccaaaacaaaatgtgtttgaacatgttatcttccccgctttttttcttcctttcttcccttatacacatcataaacaaacattgtgggataaaaatgaaaagaatatgtgaaattatgaaaatgcggcttgagtatgttaaaactagtataatgacgttgaaaggatgtgaaatgccttgtcatacaccatttatctagttgaagatgaggataacctgaatgaactgctcacaaaatatttagagaatgaaggctggaacattacatctttcacaaaaggcgaagatgccagaaagcagatgcagccgtctccccacttgtggattcttgacatcatgcttccggatacggacggctatacattgataaaagaaataaaagaaaaagatcccgatgtgccggtcattttcatttccgcgcgggatgccgatattgacagagtcctcgggttagagcttggaagcaatgattatatcgccaagccttttttgccgagagagcttattatacgggtccagaaactgctcgagctcgtgtataaagaacagcccgccgcaaagaaaaccggcatcaccgtttcttcctacaatgtgatcgaagatgcccgggaggtttatgatgaaaccggcagcctggtcaatttgacgtctaaggaatttgatctgctgcttttatttcttcaccataaaggacaccccttttccagagaagatatcctgctgaaaatatggggccatgattatttcggcactgaccgggtggtcgatgaccttgtgcggaggctgagaaaaaaaatgcccgggttaaaggttgagaccatttacggattcggctacaggatgatgacgtcatgaaaaataagccgcttgcttttcaaatatgggtggtcatctcaggcatcctcttagccatctcgattctgcttctcgtgctgttctcaaatacgctgcgtaattttttcacggatgaaacgtatacgaccattgaaaatgaacagcatgtactgacggagtaccggctgcccggatcgatcgagcggggatattacagcgaggatgcgaccgctccgacgactttccgatccgttcagcacgttcttctgccggagcgggaggaatcggccagtgacaaagacttgaactatttttcttcttcctttatccataaggtgtacaagctcgcgggccgccagcacagcgtcacgaaacgatacagcgcggacatcagcggtgaaaaagtttttttcgtcattaaaaaaggcctcaccattaacggccaggatgcgatgatgctgtcttacgcccttgattcttatcgtgatgatctggcattcaccctgttcaagcagctgctttttatcattgccggcgtgattttgttaagctggattccggcgatttggcttgccaaatatctctcacgcccgctcgtttccttagagaagcatgtcaaacggatttccgaacaggactgggatgatccggtcatcgtcgacagaaaagacgaaatcggaaaattaggccataccattgaagacatgcggagcaagctggtgcaaaaggatgaaacggaaagaacgctcctgcaaaatatctctcatgatttaaaaacgcctgtcatggtgataaggggctatactcaatcaataaaggacgggatttttcctaagggggatctggaaaccacaattgatgtcattgaaggcgaagcagaaaaacttgagaagaaaattaaggatttattatatttaacgaagcttgattatttaatgaagcagcgggtgcaccatgagacatttgacattgtgaaggtcacggaagaagtcattgaacggctcaaatgggcccggaaggaattattgtggagcgttgatacagaagatgcattaatgatgcccggtgatccggaacaatggagcaaacttcttgaaaacattcttgaaaatcaaatccgctatgcagaaacggcgattcacattcggatcagccaaaatcagcagcagattgtcatgacggttaaaaatgacgggcctccgattgaggatgagatgctatccagcttgtacgagccttttaataaagggaagaaaggcgagttcggcataggactcagcatcgtaaaacggattttaaccctgcataaagcatcaatttcaattgaaaatgaccaatcgggtgtaatctaccgaattatcataccaaagtagactgtagtgtttcattgcagtctttttttatgtgaaggaatagccgttaaaatctctgtagtttgctttcagcggtttttggcattgatgaacccatttcttttcacaaattgtctttttcggatatttcaccttttcgactttaattcctctgtttcgcaagcggctgatcatttcatctaattctttcattttcagattcaccctttcgccagaactttgaccattcggtcagctcactttataatataaataaaacaaaacaaaaaaacaagttacaatcaggttaaatttacggaatatcaatatgaccatatagtcatacatgagaagcacaagccagcctcctggctccgaaagggtggaaccattgaaggaaaaagaaaagctgatcattgaagcagcaatcaaactgtttgcccgaaaagggtacaaatctacatcggttcaggaaatcgccgatgaatgcaaaatctcaaaaggcgctttttatctttactttccttccaaagaagcactgctcctatccatgctgaattactactatgataaaacgtttacccgaatcacgacgatccaaacggagggtgacagtccgagagccgcttatcaaaaacagcttgcggtgttttacgaatcgattctcgcccatcaggattttattaccatgcagatgaaagacggttcacttccttataccgaagaagcggcgcagtgcggaaagagaatccgccggtcgatcctgcagtttcatatcgacagtcttcttgctgtttacggagaaaaagctgaaccatacacagccgagctttgttttttaatagaaggaatcagtcagatgtatcttgaatatctcattctgaccggccggtccgtacagccttcgcttttggcaaataccgtgattcacagaattgatgacatcgtaaacggaatggcgggcagacatgatgaagcatttatttctcttgatgaggcaagctcactgtttgggccccttcataacgggcagcccgatcctttaagccaatcgatcttgcagaccctccgcacgcgcatcggcacgatggacaaggcggaagcatctgaattcaccgagagcttggatattctggaagcggaaatgaagaaaaagtcgccgaaaccggcaatcatcaaaggaatgattttgaatttgaaggaatccgacctgctggctgaagatgcagaacagctcagatttttactgaaacagcagtttatttagaagaacggccgcaatgactgcagccgttctttcttttatgctttcgggtgcaccatatcttccggacgcaccatttcattaaattgttcttctgtcagaaggttcagctgtaatgccgcttctttcagtgtcaggccttctttgtgggcaagcttggcgattttcgcggcgttttcataaccgatgtgcgggttaagcgccgtaacaagcattaatgagttagagagattttcctgaatcgtctcttggttcggctcaataccgacagcgcatttgtcatggaaggaattcattccgtcactgagcagctgcacggtctgcaggaagttataaataataaccggtttgaagacattcagctcgaagtttccttggctggccgcaaacccgattgtcgcgtcatttcccatcacttgcgcggcgatcattgtcagcgcctcactttgcgtcgggttgactttgcccggcatgatagagcttcccggctcattttcaggaatgacgatttcgccgattccgcagcgcgggccgctggccagccatctgacatcgttggcaatcttcatcaggtcggcagccaatgcttttaacgcgccgtgaacgtaagtgatttcatcatggcttgtgagcgcatggaatttgttaggcgaactcttgaatgtctgccccgttacttttgtgatttcttccgcgacgaattcaccgaactgcggatgggcgttgattcccgtgccgactgccgtgcctccgatggcaagcgcgcggattttttccgttgactcaagaatcatttctttcgaacggtcaagcatgtatacccagccgctgatttcctgtccgagcgtcagcggagtggcgtcctgcaaatgcgtgcgtccgattttcacaatatcctgataagctttcgctttttcatcaagcgtcgcgcgcagctgatcaagcgccggaacgagctgctcatatacggcaagaaccgccgcaacgtgcatcgccgtcgggaatgtatcgtttgagctttggctgcggttaacgtcatcattcggatgaatcttcagctcggaatttttttctttcaataaagcagtcgcgcggttggccaccacttcattcatgttcatgttgctttgcgtgccgcttcccgtctgccagacaacgagcggaaagttatcgtcgtatttgccgtttaaaacatcgtcacatacagcggcaatcgcctgggctttttcagactctaagttgccgaggcgttcgttggcgatcgctgtgcttcttttcaatattgcaaacgccttcacaacacgctgaggcattttttctgaaccgattttgaagttctctttgctgcgctgtgtctgagcgccccaaaatttatctgccggaactttaacttctcccatggtgtctttttcaattctgtagtccatttatgtatccctccataacagttgcttcaccctgagtattattcgccagtaacagatgaaaccctttttatttttcggccttggccgtttttaatttcagctcaagatagacgcgcgaatccttagagtatttatacttcggatttgttttacggtattctttcgacgtgtaagccacttcgtaatgcgcttcaaatgatttgatgagctgttcaatttcttcggcatttcctgccagtctgacttgtgccacatctctcctccgctttcataaaaaaacttgtaccattaaatactttatcatagtatatcatttttttaacaggaaaagataacctcaattaaggattggaaggcgggtgactgtcgatgacgcaatcggagttcaaggaatacatacacgttaatctggcactggtgcttccccacgtagagcagaatgatgacctggttcaaaataaaaagatgcttccgaacgggcttgttttttattatatgtatctgagtgaaatgaacgacgaagacaaaataaaagaggcgattgaaacgctgcttcaggaggaagacactctgacgctggatacggtggcgaaacgtcttgataagatcaacgcccgtcccgtctttacgtcgaaggaagccgtcatctccattctgcggggaaaatgcgccgtgtttattaacggacttgacagcgtatacattttgtccacgggaaaaagagaaaaaagaagcgtaaatgaacccacatccgaaaaggtcgtaagaggtccgaaaatcgccttcatagaagattctgatacaaacatcgccatgatcaggcagcgcacgaaccatccgaagctgaaaacgaaaaaggttccgatcggagaaaataagttaaaatacgccacggtcatgtacatagatgataaggcggacccgtctgtcgtcagcgatgttgtaaagcgcctcagcaaagtgaagatggatgacatccaggattccggaacgcttgaggagcttattgaggataataagtattcgccctttccgcaaatacaaaatacggaacggcctgataaagtctcttccgccttgttcaacggccgcgtcgccatccttgtcgacaactcgccgtttgcgctggtggttccggcttctttaggaattttaatgcagtctcccgatgattattatgaacggtggatttccgcctcgctcatccgggcgctcaggtttacgtctatttttatcacgctgtttttttcgtccatttatatcgccctcgtttcgtttcaccaagggctgctgccgacgtcgcttgcagtcaccatcgcggcgaacagagaaaacgtccccttcccgcctatcattgaagcgatggtaatggaaattacaatcgagctgctgagggaagcgggcttgaggcttcccagcccgctcggccagacgatcggattggtgggcggagtcgtcatcggccaggcggccgttgaagcgaatattgtcagctccatcatggtcatcgtggtcagcattgtcgcgctcgcttcatttacggtgccgcagtacgggatgggtctgtcgttccgtgtgctccgttttatttcgatgtttaccgcggcagctttcgggctgtacggcatgattttatttatgctggcgatctacactcatttatcgagacagcgaagcttcggttctccgtatttctcgccgaatggatttttcagcttaaaaaacgcaaacgactctattctccgtctccctattaaaaatcaaccaaaagaggcgaaaaacgtaaatgagccagaaaacaactcacaataagcttacaagctatcaagggacagcattgattgcaaacacgatgctcggcgcggggctcctcaccatgccgcgggcgctgtcatccagggcaaattcgccggacggctggatcgcgttatgtctggaaggcgtcatctttatctttttgatttatctcaatacgctcattatgaaaaagcatcagtacggatcattatttgattatatgaatgaaggactcggcaaatgggcgggaaatatcgtcaatctgatgatctgtctctattttataggagtcgccagcttcgaagcccgggcgatggcggaaatggtcaagttctttttattggaaagaacgcccgtgccggtcacactgtttatctttatcgcctgttccgtttatttaattatcggcggcatgagcgatatcggcaggctctttcctttctatttaacgattacgatcattattttgctggtggtgttttctttcagctttaaaatatttgatctggacaacctgcggccggtgctcgggcagggattttctcccgttatggcttccttgaccgtcgtttctgtttccttcttgggaattgagattatgctgtttctccccgagtacctcaaaaataaaaagcacacattccgcatgtcggccataggctttggcatcccgattattttatacatcattacctacgttctcgtcgtcggcgccttaaccacccaggatgtcaaaacaatgatctggccaacgatcgcgctctttcaatcatttgaaatcaaagggctttttattgaaaggttcgagtcctttttgcttgttgtctggatcatccagtttttcgccacctatgtatcatacggatatttcgcgacatcagctcttcataaaattttcgggctgaaacagaaaaaaggcatcatcttcgtaggcatcgcgacattcttcggatcattgttgccaaaagacggaaacaagctgatgctgttcagtgatattctcggctatatcttcttggttttctttttgctgcctttactgatgtttgcagtcgtcgctgtgaaaaggaaggtgaaaaaagcacaatgaagaaatacatcgtaatcatattttgcacattgcttttggccgggtgctgggacagccgcaatttagaagacttgagcctcgttatcggagtcgggctagataaacccgcggaagaaaatgtggaagtgacacagcagattctggttccgcaaaaagcaagtgcccagcagtcgtcgtcaggtgacacgacaaaggtgacttccactccaggggaaaccgtccatcaagcattaagaacggcatcgttaaaaaatcaccccgccttctcccagcacttgcgtatcatgctgttttccgaagcgctgttaaaggatgacattccgcttgacgcattgatgaaccaatttatcagagacaacggtacgagaagaagctgcaatgtgatgacggtgccggataaaacgaaagatattttcaatatcagtgaccagggagaacctgcgtcaaatacgatctatgacttaacggagaataattcggtcaccatccggatgatggagcccgtgacattgggggaaatatcagagaaaatcgccaagggcgaaacctttgcccttcctcaagtgcgcaaagtgggcagcagactggaaatctggggcgctaccattattaaaaataaattctggtatgcaaatttaacgcctttacaagtccagaatatgaacctgttcacaggcacggtaaagggaggcgtcacgtttgcaaagcatgacaattattatttatctttcgaggtattttccagcaaatataatgtaaaaacacaatataaaaacggaaaattcaagtttatcgtcacccggtttgttgaaggccgtctgtctgaggattggaatccgaaagaagattctttcaaggagtcctatataaatgaaatcaaaaacgcggtaaaacgcagcattcattcagatgttatggcattcattgattacatgcagcatgagttgaaagtggatattaccgggttaggcgatcaagtccggattcattatcctgataaatggaaaaagatatcctctgactgggatcatcacttcagtgaatcggatattgaatacaaagtcaaagtcgccatcagggatttcggaacaaagggaatgtcccaatgaccccgtccctcgggagagtgtgccggcgccgctctcctttttttatgtcacgagatgattgcggtgggcatatacggctgcctgcgtgcggtcactgacatcaagctttgacaatatattcgtaatgtgggttttcaccgttttaatcgtaatgaacaactcttcaccaatctctttattcgtcttgccttccgcgacgagacagaggatttccagttctcttttcgtcagcgtttcatgcggaagctgattctctgaatggcgcagccttgacagcacttttcccgccactttcgactcaagcttcggttcacccttggcagccgctctgatggcttctgctatttctgccgccttggacgttttcagcaaatagctgagcgctcccgcttcgatcaccggatacactttgtcgtcatcaataaagctcgtcagcacgatgattttcgggtcattgagtttcgcgcagatctgttttgtcgcttcgatgccgtccatgccgtccatgacaaggtccattaaaatcacatccggcaaaagctctgcggccagatcgacgccctgctgcccgtctgatgcttcaccggcgacttcaatgtccggctgtgcttctaaaaatgcggccagacccatcctgaccatctcatgatcatcaatcagtaacactcgaatcactgtcgttctctccttttgttttctgataaatcgggactttcacgtcgatctgcgtgccttttcccttcacggagataatttccgctatgccgccgatttcactcgctctttccttgatggaatgcaggccgtatgaggatgctttcacttgatccatcgtaaaaccctccccgttatcaatgactttaagctgcagcttttgatgtttcgcgccgagcctgacggtgaccttggtcgcctttgaatgtctgaaaacgttggaaagcgcctcctgcacgatgcggaacagatggtcttcaacaccttttgacacacccgtatcgctgatgtcccactcaatatccagcggctgcttcgctttgaactcttttaacagctcaatcagcccttcttttaagccttttccttctaaagtgacgggccgcagatgcaatagcagcgctctcatctcgttttgcgcttcccccgccatatgttcaaccatgcgaatccgtttgacgattttgtcatccgcatctttcacctgctctaagacggcggatgtcatcatagaaatggcaaagagctgctggctgacggcatcgtgcagatcgcgcgccagccgctggcgttcttcagtgatgaccgattttttcatttgatcctgccattccgcccgctcgttggagagtttttgcagcgatgtgacctggagctcgacccgcttggccatttcgttaagctgatctgccgccaggccgatttcatcatcgccgagcggcggcacccgataagcgaaattgccgttttcaaatttcaaaaccgcttcaatcagtgtatccattcttgttttcaggcggccgccgtatacataaccggaaatcaatccggccgaaagagacgccagaagcaggatgaccacaaacggaataccgaaccagccggaagaaaacagcagcatcgggtcaagcccgtaatacagcagcatcagcgtaataaacaccgcacaaaggagcagactgagccccgcagtcatccgcatggcgcgccactgaatattggcgagtaattttttcctcataaatacttcacatccacatcgccgatgaataaagaaattgaaattttaatccgccgcggcgagtcgccgtactcagacgatactttataaagattcgggctcatgccgcttttcttagagccgagcaggttcatatcgccgataaaagccgatgaactgacggacacttcgatatccggcgggacgtacacatcgacattgccgatgacaccgctgatggtcatcgtgctttctccttcgggaatcatcgcttttgacaaatcaattttcacatcgccgatgaatccggaaacatttaaatcattcagctcaaacgggtccttcatcatccggagctcgccgataaaaaagctgcggaggtccggctgtctgctttccgtctgggcggaaggctttggctgctcttctttttcaagattgattttcttctctttatgttcatacacgcgctttcctttcaggagcctgtagcccgcgtatatgagaaaggcggcgaaggcatagccgaacaggttaaaggtggcgctgaacaggttcctcaaaaataaaaaagcggcgaagatatacaggacggagccgagccagccgcgggaatatttattaaaaatatagcctgtgatcagaaaaaagagcggccaaaacaagaagtcgccgatgccgataatacgcaaaaacatgctgacgcctaataaggcgatgataagtccgagaatctgtttttttgccatcagctgcctgcccctcctttccttgactattgcagtgcaatattgccgctcgtcacttttatatcaatcggcctggcgccgctgcccttcataccggtgaatgccccgccgtccttactcgttttctcaaaggaataagacggctgaatccttccgcttgccgtctcggcgttcaccgtaaaacttccgtctttcggcaggctgatcgctgcgctgccgctcgcaagcctgacggatacgggagcatccgccatctcaagcgaggcgtcgacactgccggaagcgacccgcacgtcaagggcgcccgccgcatgttgaagcccgacatgtccggaggataagcggatatcccccgttttcgccgcaaggcctgatgctgtgaggttgcccgacagccctttcgcttcaaacacatccgtcttcacgtgcttcagcgacatattcccgcttacagaacggacgccgaggtgcgcaagagacagccccttgtttccgtcaacggcaatggtgccgcttgacgtatggacggtaatgtcccgatgataatcatacggaatgcggacaatcagcagaggacgctgaaagagattcagaaattggaaccctttctccttcgctttgagattgagggtttttcccctgctttggacaaacattttccccgccggtcccgccatgtttgccgcgatatcattccgcgcttccgcgatgatttttacatccgtctgttccgatgaaaccgacaggctgttgacggcacgcggcggtatgcttgccgattccgcttctgtttcgtacagcggaaaaaaacgcccggcaaacacttctttcaccaaaaacagacagcagatcagaacggacgccgccatcagtcctttggccatcttacgcttcattacgttccatcctttttcattcattttattataaaggaaaagccggagaattgatacgtgcgtatagggaagaggcgtaaaagcgccgatcttcccttgtgcacattattcatgagccgctttttgatgctctgttttctccagagaaagcgagcgcattttttcaatctcagcttccacctcgtctgaatattgggagcggctgtattctgtgttcgcctcagctgaagtgccgtatttgacgcggacttccatttcttcaatgcggctttccattcgaagaaactctctgtaggcgctttcactgtcaattttgtcgaaagaagcgttcatatgttccttcgcttttgccgcgttggcgcgggcgatgagcgcctgttttttatcctttacgtcgcggaggcgcgtttctaaagtttccagctgctctttcagctctgccagctgtgttttcgcctgctcatacgctttttcatgttcggccgcttttccctcaaggtatttcatttcagtcagcgcctttttcgcaagctcctcttccccggcgtcaaaagcaagctgagcctggtttttccgttttgccgccgtttcggaagcgtcttcctgttttttcttaaactgatggacgatcgtgtgctgtttgacaatcgtttgtttcgccttagcaatgtcactttccatatcacgcacatattgattcagcatgactttcggattttctaatttatcaagcccttcgttaacagatgcgacgaacatatttcttattctttttaagaccattttgtcttcctccttattttttcttcagaaattcttcccattcagagtcaaatccggattgatagcccggtgatgccgcttccggttcatactggcgggaagcggtgtctgagccgccctgcttcatcatcttccacccgaaatacaccatggcgccagccagtccgatggcaacgataaatggaagagaaccgacgagaatcatagctccgatgaagcccgcgatgatacccgataccgcccggccttttgaaaaacgtttgattccccagtaaagcatcaggcctccgatcgccagcgggatgataaatgcgaaatggcctcctccgaaaaagacagaaagtccgaacacaatcagcagaaagccgcctgccgtttttacatttatattcatgcagatcctcctttcgttttccttgtctttactataaacaaatcccgcggccggcaaaacgagtcagagattgattttcatatcagaccggagtcgtataacccccggaccttcgcataaaaaaacgccgctgcaccggacggcgcagggcgtttcacgaaaaatctatattctgatgctcgcttctttttccctgatgagatctgagcgttcagctttggccagcttcgtaaagagcaatattccgagaccggacaggacttcaacgagaccgccggcggcaatgacttttccgggaccgaaggcgttagccgcgtatccgcaaagaaccgcgccgagcggaatggatatgtttgagatcatatggatgacggcatagacttgcggctgatcatcatggtccacagacgtctgaataatcgtatattccggcacattaatcgcgctgacggcagatccgaacgcaaacgcggcgaggaagacgagcggcagaaaagtgttgaggccggtgatgaaaaatgccgccccttctatgattcccgctgacacaaacaggagaccgtatttgttcaccttcaccttagccaaaataaaacccattaaaaaggctccgcccgtgcctgtcgctttcaaaagcgagtagatgatcggcggcatgtttaaatcttcggcgacataaacggcagagagcgcctcccacggagcggccgcaaaattcatgaagatacaatagatggcgagcgggtataaaatctggtgtttcctgacaagaacgaaaccccgtttgagccttccgacatacgtcccgcgctgtctgacggcgacggtatcctctttggcatgctggacttggtatgacataaagagtacgagaaaacctgatagaagatagaatataagagcgataaacaaagaataagcgggactgataaatgttaagaacaccccgctcagcgtaatggcggcaagtctgacgatctggcctgatgactggatgaccgcattcgctttctgcaggctgttttctccgacaatattggggattaatgagatagatgcaggattataagcggctcccgtggctgaatgcaaaatcatgagaagcatgacaaaccataaaggagaaaaaccgttaaagtaacagaccggaatgatcaacacgaccgccgcgcgcgtgagatcggagaaatacatccagaatttcagcgtatgctgcttcataaaaggcccggtaatcggcgccagcatcgcctccggaaggaacgtgaccgcaatgagcagggacgtgccgatcgcgccttccccgtcaaaaatcaaaaaccacagaatggaattaaaggcaaaaccgtcgcctgacaatttaacaagcctcgagataaacagaagggtgaaatttttattccagatgctctcgctcttattatatgtatccatctatcaaatcccccattattttacaatgtttcttataatatctcattttttaatttttcagtcaataatgcataagatacattttccttctgtcaataaaggttcaattgatggatatctctataaaaaaacagccggcttgctgctgccggctgaacaaaacgttattcatcatcacggaataccgcggcgcttctttcatactctatatcctgaacgccctgtcttgcgttaactgctcttgccgccgcgaaaaaataatcagacaggcggttcaagtaacgcatcaccgtatcgtttatctcttctgttttgcccagtttcacgacgagacgctcagcccgtcttgtgacggtccgcgcgatatgaagctgagcagccgccttatgcccgcccggaagaataaatttctcaagcgggggcgcttcagccgtgtaacggtctatgcagtcttccaatgcggaaatagatgtctctcttaatgtatagcttctatgttcagtgaccgtcgccaagtcgccgccgcagtcaaacagctcatgctgaatgtttcggagttcggctttcacatcaccgcaattctcacaattatctagctccgcaagcgcaagcccgataaagctgttcagctcatcgatcgtcccgtagctttcaacccgcagactgtctttatccgttctgccgccgatcaggcttgtctgtcctttatcgccggttttcgtataaagcttcattgttgtattcctccttcttccgccgcttttacacataccgcggttcctcttctgacggctctttccgcgtgagggacgtccattgcctctcctgtctgcaaggcacaaatggcaatgtcgccttttgccagtctgccggaaagagcctgcattctcgcttcagccgctgccgttaacagccgaacaaatccctgttccgataaacgtccgctgatcagcacccaaacggtatactgcgcagtcacggctatcgtaaccgaatcaaacgtacggcagatcaaaccagctgccgccgagccggaaagccggcggctccacgaaaagcccgggccgtcagatgcggttgacagcattctaaacggccgttctgtatgaagcgttacggtatttccgcttttgtttatcagagaggcgaacggaacgccggcgggctctctttcctcccgcgcttccggcatgaaagcgatcagcggtttcggcgacgattgccgggcaacagcgctgacggtaatgccgtaaatgtcttcaatcgtctcttttttcaaagcctgatccggtggctgcttcggaaaagcgcgtccgtctttcatcatcaggagctgatcacaatattggcttgcgacgttgaggtcgtgaaaaatactgatgaccgtcaggcctctttctctcgtcagccgcttcaccgtatcaagcaggtctttttgatatttgagatcaagaaaggtcgtcggctcatccagacacagcacctcaggctgctgagccagcgcctgcgccagatagacgcgctgccgctcccctccgctcagattgcggacggattgctgtgcatatcggtcgatgcccgtcatttccattgcttcccggacaatgtcttcgtcatgttgatccatctgtctgaagagtcctttttgatacgggtatctgccgaaggacaccgtttccttaacggtaaatgtaaaagcttgctccgtatgctgcggcaaaacggccataattttcgcaagctcccgcggcttgtatctgcccgcgggcctgcctgcgacgagcacctcgccctttgacggagagagcattcccgtcagcaatttcatcagcgttgtttttcccgagccgttcggaccgagtatgccgacaaattcaccttttccggcggtaaaactgacatcttctacaatcatccggcctccgtacccgccggacaggctgctcaccctgatcataagcgtttccctccatgatgctggcgaagcagaatcaaggcaaacacaggcgctcccgccaaagccgtcataatgccgatcggcaattcgacaggctcaataacggtgcgggaaaacaaatccgccaaaatgagaaacccggcgcccgtcaatgctgacagcggcagtaaatggcgatgatccgtcccccacaaaagccgtgtcacgtggggaatgacaaggccgacaaacccgatcgtccccgagacggcaaccgctcctcccgtcaacagagatccggcggcgatcatcagcagttttctttttcccgtactgacgcctaacagctttgccttttcttctccataagtcataatgtttaattctctgccattgataagcagaagcgccgtcccggccagaaaaaaaggcagaaacagcgcgacatagccccagcccctcattgacacgcttcccaacagccagcggacaatcgggagcagatcatttcccgttaaagcaatcacaagcgaaatgagagccccgagaaaagaattcataatgatgcctgtcaaaatgagcgtcgaaaccgacatcgacgcatgaacgaggcggctgaaaaacagaaccgccgccataaccgcaatggcagcggcgatgctgacaaccggaagtgtgaaccggccgatgacgggaatctgaatgccgaaaaacaaggtgataacggctcccgccgaggctcccgaagataccccgagtgtataagggtcggcgagcggatttttcagaagtccctgaaacgccgcccccgcaatggatagcgcggctccgacaagagcggccagaacgactctcggcaggcggatattgatcataatatttacattcatgggatcaacagaggatgtccggccgatcccgatccaaaaaacgtcggataaaggaatatgcagactgccgattgaaatgccgagtgccgtacaaacggctaaaaacagcaggctgaccgtgtaggccagcgggcggttactttttaaacgtttcaggataaacgctttctgcaagcttctcgacccctttgacaaggcgcgggcctgagcgtgtgacaaggtcaggatcaacagaatagacattgtggtgtttgaccgcattgacggcaccccagccggcgcgtttttccacttcagcggcctttacgccgtctgtcgtgatgataacgtccggattcattttgacaatcgcttcatccgtcagctgcacccagccggtctggctgccggcggcgtttttcgcatgtatatcttcaagcatttcgttcataaacgtgtctttccccgtcgtgtagccgtcaggagacacttcgacgaatactttcttttcgtctttttcagaaatggccgccgctttcttttctatgccggaaaggtcggatttcatcgattggatcagctgatccgcctgcttttctttgccggccgcttttccgatcatgctgattgatttgtacacatcttggaacgattgcgcatcattgaccgttaagacggtgatgcccgcatctttcagctgcttcatcgcatcggcggaagcggacatagaggacgcgtgggcaagcacgagatccggcttcagcgcgatgactttttcagcgttcacattcatatctccgactttcggtttttttacggcttctttcggatatgtatcatttgtcgtgacgcctgcgaccttatctcccagtccgagcgcgtatgtaatttccgtattgctcggcatgagggaaacgattttttccggtgcctgctttatggttactttttcgttcgcggcatccttaatggttaccgggaatgcttcggttgagacggctttttgtttggccgcgcttccttcttcctgtgcgccggaacagccggcgatcacaaaggcggtgaccaagagcgccgcccagacggcagtgatcttcttcattcttttaactccccctgattatggtaaacgattgtctctttgacattcgtatccttttttcgcagtaattatactataagtctttaaggcttgtatatccggcctttttgcatgaaagcaaattgttcgtacacactaaaattcatcatgtatactgttacacaatggtgtaataaggaggattatcatggaattacagcttgaacgaaagctcgtattgattacaggatcaacttcagggatcggaaaagccgcggcaaaaagctttttagccgaaggcgccgaggtgattgtaaacggaagaaaaaaagaaaccgtggaacggacggttgaggagctttccgcttacggaacggttcacggcatcgctgcggatttatcgcgtcaggatgaggcggatgacctgatcaagcgcgccggcggaatcggggaagtcgatattctcgtcaataatctcggtttttttgaagtaaaggacttcgctgaggtgtctgatgacgaatggactcggtattttgaagtgaatgttatgagcgccgtgcgcctgtgccggcgttttctgccgcaaatgcttgaaagaaacagcggacggattttgaacatctccagtgaagccggagtcaaaccgcttgcgcaaatgattccgtattcaatgacgaaaacggcgttaatcagcttgtcccggggaatggcggaaatgacgaaaggcacgaatgtcacggtcaactccgtgctgccgggaccgacatggaccgaaggcgtcgcttcttacatggaaggagccgcaaaggctgccggagaagacacggacagcttcgtccgggattattttaaagtgaatgaaccgacatctttgattcagcgctatgcaaccccggaagaagtcgccaatacgattgtatttctcgcttcatcagctgcttctgccattaacggcaccgcacagcgggttgaaggcggcatcatccgctccatttaacacaaaaaagcccggcacaaggggaacttccccatatgccagggcttttttttacatcatgcctgcaaacggaaccggctcccagccgcccgtctcaagctctgctgaaaacaggccgcccgcatgcggctgctcaagtctttcggcttccgtcaatttttccgtcgcggtcgtaatgtataacgtgttcaaattgctgcctccgaacgcgcagcaggtgacgtatttcgccggaacttcgatagatgcaatttccttatgcaaaaacgggtcaatccggacggcgcggccgcctccgaacagagccacccacagcattccgtcacggtcaatggtcattccgtcgggagatccttgcgactccggaaagcggtagaccgttttcggatctgatacggctccggtttcaggatcatatgcataacagacgatttcctgcgtcggagtatcaatatagtacatcaggtttcggtcccgatcccaatccaaaccgttcgaggtggagacctggtcttttattttggcaaggctgccgtccgtattcagacggtacagcgaagcctcctcttctttgccttccatgctcgtcgttcccgcccataatctgccggacgggtcgcattttgcgtcattgaaacggatatcttcccgcatgtctttcggctgcttcatcttcgtcaatgtgtcttcccgcagattgtacaggtaaaacccgtctttcatcgtcatcaccagctcttcctttgaatacaaggccagagccgtgacaaatgagttgaatttaacggaacggttgattccgtcagccggagtgaagatatggagctggctgcccagtatatccacccagtacaggcattccttatccttgtcccataaagggccttctccgataactgctctcgtatctgctcgtaatgctgcttccatgtgtgaacacctcttttgcttgtcagtcttctattgttattcccgacaaagcggcgtccaaactcaatcttttttaaaaagaatcgtaatcaccgttccggcgctgattctgctgttgacatggatggttccgttatgaaggtgaaccagctctttggcaatggcgagcccgagtcccgttccttctgacggccccttcgtattcgttccccggtaataacggttaaacagctggtgaatcgtttcatcgtccattcctcttccgttatctttcaccttcagaatgagctgttcggctgattcctcaagcaccacccgaatggcggtccccttcttattatgcttaaccgcgtttgccagcagattctccagaatacggcggaaccacgcttcatcaatggcgaaaagaatgtcttcctttttggtttcaaaggcgatgtcatagccttccgagaacgtgtttttcgtaaaatcgttcgtgacgtttctgataaacggcacgacgttgatcagccgccgttcgatcgggagggccgcgtttttgaggcggtatgttaagtttaagtcctcaatcagcttagacatatattctgatttttcccggacgatctgccccatttctttgacttcttccggtgtccagtcgtattgcttcgattcaagcatcatgctgtagccgtaaatcgtgctcagcggggtttttaagtcatggctcagcccggcgatccattcttcccttgtcgcctggattttttctctgtttttcttatcccgcttcagcgtgtcggtcagctgatccatcgattcgaaaatctcggcgaaaaagcggaacggctgttttgttttgccttttttgtttttgctgaccggctgtcctttgcggttcttcggctcttcaagccggccctttgataaattgacaagccatttgatggtatgaaacagcggccagccgaaacggaaagagtaccagatggtcaggatgcagatcataaatactaagattccgatcaagaggaagagggttttcatcacatttctcaaaaatgatttgttaaactcgtgatcggggatgtacacggggttcggcaccgacgcgaccatccatttcgttttatcgagtcttttaaaagaaatttcccgtttgtaattccacggcttggaactgtatttcagcaattcaagctcattgacggtgttccgttcttttttcgtgctgttgatatccccgagcagtctgccgctgttttcgagaaggtagaccgcccctttttcccgtttaatataatcaaccgtgctttttttatattgagaaagggaagcgagggatggctcctgtgattcgatgtaagtgagaagctgctcactggcggatttccagccgaacagaatcaaataggtctcatcatttatcgtgaccgtccagtaattcagcttgtagttgtcaaaattccggtactggtaaatggataagaggtcttttctgctgtaatggctcgggacgtctttcggcactctgtatgcgtagtccgttttttctttgtcattaatgatctgcagccagcccttctgctttctgaccgacatctttaaaaattcatcgacatcccatgtgccgtcttcgtttttatcaagccacgcttcaaacgagtctgccgtcgctttggtcagtcccgcattggcttccgcttcgctgaaacgccaatccaaatagaagaaagaagcgacggccaaaacggacatcagcaggatgacaagcagaagctgtccgaaaaagtggagcagaaattttccgcgcattctcatgagcggattcctttttctccttgatcgggaataaaccgatagccgaggccgcgcaccgttacaatataagacggattgctggggtctttttcaatcttttctctgagcttgcggatatgcaccatgacggtgttgttatcgccgtaagacggatatccccacactttttcatagatctgatcttttgagagcaccacatcagggtgttcacagaaatattgaagcaattgcagaagctgtgcggagcagctgacgggctcgcccccgacgatcagctcggcgttttgcggcgaataggaaaaatggctgtatgaatacgtttttaccgccgttttctcttcgcgcttataggttctttttaacgtcgctctgatccgcgccgccaattcgagcggattaaacggctttgttatataatcgtcagctcccaatgcaaatcctgacagcttatccgcatcagaagaacgggcagtcagaaaaaagatcggagcgtcggtataattccggatttcggtgcatgcttcaaaaccggacatgccttccatcatcacatccagcacgagcagatccgcggtttcatgtttaacaaactcaatcgcttcctcagcgcttccggctgtcttaatgttgtgatagccttctttgacgagaacgcgtttgaccatatcaacgatcgccttctcatcgtctacaattaaaattgacgcattttccaccttggacgttcctttctctttgtttttttcatcatatcattatatggataagatttggtacctttttagtgcggaggtcttgcggggaaacagaaaagaaaaacgagacggacatctcttctcgtttttctcacgttgtcagagcggaatatccatcattccgccgcttttgtcaggagctttcatttataagatgaagaataaattcccaaaaacccggcacttcctggcataacagcatgtccgctttttcaactattttaatcttcaattcttgttcaaggtcttctctttcctggtatgatgtattgctcagtttttttttatcattggcgaaaaacgtgaaatcaaaagttccatttcgtcggtatctgtgttctctttgttgaagtcaaatggcccgttcactgcttattttccccctttttttgcttgtccagctgctttctgagattgtcgagcccttttttatgaatattggaaatgttctgccgtgattcacccagcgactcggcaatctctttcatcgtcgctccgtgaagataaatattcgtcagcacgcttttttgtttatcggttaacgtctgaagcgcttcgtataaatcacggttttggacatgctggctcaaatctccctgcttccgcagaaactcttcatacgcgtcttttcccatttcatagggaagcgcttcacctccctccggctgatccaccgtcagcggatagcgattctgatttttacggatgcgcttgtcaaaatcgatggagaaaatccggatcatagagttcatatatttgatgatccggatttccttataaaactgtttaaaatggtcgtccaatgattttgcatccttctcgtctgaatgttccagcacatttttaaatttctcgtaatgctttgggtcacttaaaaaatgtttaacgatcggatgtttcataatttccttgcattttgaccgtaaaagaacttgatagtccataaaaccgccccctatttaaattaaatgaaagaaagcaaaaaaaagtaaactactcctttccgactaagattccgcattccttatgtcccggatttgccggaacaaaaaaaaagaccctcaaccgggatatcaggtttacaggagccgctctttctttcacttatatacatgactgcaggtcaagtcaggaggtggctgacaatggatcaggtttttatagaagaagcggtcagacagatcggcaatctcggctttccggctctgattgctatgtatcttctcacacggtttgagaagaagtttgacgccctgatcgaactgatgacggaactgaaagatcagaaaatgaaaaattaattttcacacgaagttgacttttcatcggaacgcatcacttaacaaagcagaagggaaaacgaaaggcctttcacattctctttctgaaaaaacaaagcttgagaggagacgatttacatgtcaaaagaaaacaactgcaatatcccgcagccgatcagaggagacaaaggagcgaccgtcacgattccgcgcaatcttgaaagagaccgccaaaatccggatatgctgacgccgccggaaacggatcacggcacagtggataatatgaaattctctttctcagatgtgcataaccggctggaaaagggcgggtacgcgcgtgaggtgaccgttcgcgagctgccgatttctgaaaatctggcatctgtcaacatgcgtttaaaaccgggcgccatccgtgaactgcactggcataaagaagccgaatgggcatatatgctgacgggcaaagcgcgggtcacgatcgttgatgaacagggacgcagttttatcgatgacgtgaaggaaggagatctgtggtacttcccgtcaggcctgccgcactccattcaggcgctgaaagaaggctgtgaattcctcttggtttttgatgacggttccttctcagaaaacagcacattccaagtgactgactggcttgcccacacgccgcttgatgtcatcgccaacaatttcggggtttcagaaaaagacctcgccggcctgcctcggaaagaaaaatacatctttgaagagccggttcccgggaagctgaaagacgacattgtggaaggcccgaacggcgaagtgccttatccgttcacttaccgcctgctcgatgaaggtccgactgctgagacggaaggcggcaaagtatatatcgcggattccacaaacttcaaagtgtccaaaacgatcgcttcagcgcttgtcgtggtcgaaccgggcgcaatgagagagctgcactggcatccgaatacgcatgaatggcagtattatatttccggtaaaggacggatgacggtttttgcatcggacggccatgcaagaacatttaactatcaggccggggatgtcggttacgtcccgttcgcaatgggccactatgtggagaatttgggggatgagccgctcgtcttcctggaaatcttcaaggatgaccactatgccgatgtgtccctgaaccaatggcttgccatgcttcctgagaaattcgtccagcagcatctggatctgggcaaagactttacggatattctttcgaaagagaaacaccctgtcgtcaaaaagaaatgctgaagatacacacccgacttgcagagttccgtctctgcaagtctcctctgtgtgaaaaggagctgaacagatgatcaatcaaaacgggacgaaaatgttttttcttcaggtgctccggtatgccctggcagccgctgccgtattattcgggtatttcatcgtgatgatggccgtattttcattagccgggacgagctacggatcgatggcgtacgtcctgcttttttccgtgctttttattcttctcggtttatgttttgaaccgcttgaacggctgatgatacatagctttaccttttttgggacgggcaggctgccttttctccttttagccggcaccgttcagctgctgttcctctggatgactgcgtatacgacggataaactgattgaaaagatttggctgtcaacgacggaggagctgattgtggcgggggtttttttcgttttggataaatgcgtctccggacaaaagcagccccgggcgcactaaaaaaacgcaggccggaatggctctgcgttttttttcatcttacagttgcgttttcatgccggattaaatcgtaggttaagcagaccggtttgttcgtgcgcggatcttttacaatctgtgcgtcaatttgaaacacgtcttccaatataccgggagtcatgacttcctccgccgttccttccttgatgacgcgcccttttttcagcgcgatcatgtaatgggaaaaacgggcggcatggttcagatcatgaatgaccattaaaatggtgcggccctgctccttgtttaatttgtccagcagctgcaaaatttcaagctgatgggcgagatctaaataagtggtcggttcatcaagaagcagcagctccgtttcttgagcgagcgccatggcgatccacacacgctgccgctgccccccggaaagcgcttcgatcggccggtcgtaaaattcggccatccccgtctcttcaagcgcccatttgatcatgtcacggtctttatcactcaagcggcccattccggactgatgcggaaacctgccgtaagaaacaagttcgtacaccgtcagcccgctcggcgcttcaggcgtctgcggaagaattgccatttccttggcgatgtccttcgtggatttttgcatgatcgcctgtccgtttaaatagacggcgccggatttcggtttcatgattcttgacatcgttttgagaaccgtcgattttccgcagccgttcggaccgatcagcgttgtaatttttcctttcgggatggcgatatccaattctttcgctatcaaacggtcgccataaccgacagtaagctgttccgccgataatgagttcatcgcggcagtctccttcctctatttcgttttcatcagcaaatatacaaaatacggcgctccgagcacggaaatcaccaggccgacgggaacttcggacggtgcaagcacatttctcgccagcgtatcggcaagcagaaataaaaatgctccgatcaaagctgaaaccgggataagcgtctggtggcgcggcccggtaagccttctggccaaatgcggcgcaatgagtccgagaaaagcgattccgccggctgccgcaacacatgacgcggtcagggcaacggcggacatcagcagaacgcgccgctccttttcaaccttggtgccaagccccgccgccagctgatcaccgagctggagcacatttaaatacctggctttatagaggctgaacggtaaaagaaccagcagccacggcaaaatggacagcaccattttccaattggcgttccaaatcgaaccggaaatccatacaagcgcctgcatgaaatcccgcgggtccattttcagctgaaaaatcaagagaagcgcattaaaccccgcattgacaccgatcccgaccaaaacgagccggacaggtgaaacgccttttttccaagccagcacatagatgagcagcgcagccagaaaagcccccgccaaagcgctcaccggaagcagccatgtactggccatgcttagatcaacagctgacccttggaaaaagaagataaacagaacgaccgccaaagacgccccggcgttaataccgagaatgcccggctccgccaagtcattttgagacacgctttgaaaaatcgcgcctgaaaccgcgattcctgcgccgacaagcaatgacagcaccatgcgcggcagtctgaattcaaataaaacgagctgatcccgggcatccccctgtccgaaaaagacacgcatcgtatcaagtggcgcaatccggatcacacccatgtttaagctgataaaaaagacgatgcatatgagcacaaacgtaacggccatgaccgccagcggttttttcgattttacattcattacagccctctcctttccctgcgcgccaaataaaagaaaaagggaacgccgataagggcggttaaagcgccgaccggtgtttcaaacggcgcattgacgagtcttgcggcaatatcactgaagactaacagaacggcgccgaataccgccgaacagggaatgatccacctgtaatctaccccgactaaaaatcgggtgatatgcggaatcaccaagccgataaaagaaatggctccggcgactgagactgaagcccccgtcaagaggacaacgacaaacattccgattactttcacaagcgatgtgtactgcccgagccctttggccagttcctcacccaagctcagcaccgtcactgagcgcgcaatcagaaatgccagcaatagtccgataaccccgaccgccaaaagcagctgcatgccttcccatttgacggaagcgactcctccggcataccagaacttcacatcctgggcgacatcaaaacggatcgcaatcgcgcttgaaagccccgttaagaaatagccgactgccgtaccggccagcgcgagcttcaccggtgtcagaccgccttttgaagacaggccgatgccaaacacaataagcgctccgattcccgctcccgtaaaggaccacaaaacaagtcccgccgcagacagacccggaaaaaaagcaaatgccaatgcgatcgcaaatcctgaccccgacgtcacgcccataatggaaggctcagcaagcgggttccgcgtcagcccctgcataatcgctccggacacagctaaaaaagccccgacgagcgcggcggcggcggttctcggcagcctcagatcgcgtatgatttgatgagatgtattttgcggctgaaagtgaaagagagcatcccacaccgtccgcagatgaatatcggcagctccgatggaaacagacagagcggcgccgatcaataaaaccgcaataccggcacacagcagcacagcagcccggaatgaacgcgccgtccactggatttcactccctgatgccccttgagccgtcattgtctgtttctttttcaatagacccaacactcgttcttcctttctcaaaacaagaatggtaatgataatgattatcaatgacttgtttcagtatagcacttttatcttctcttttaatagacctaatttcatataaaaaaagaaagtttttctttaaaaagagcgtgcttctctatgaaagcagtgatataatcacactgataatgattctctttatcactaatttttatgaaagaaggaatgtcagatgttccatacatacaagaaaatcggcgcagcgctgattgccgtgctgctcttcgccgctttggccgcatgcggcaattcttcagacacaaaaggttcttctgaaaaagaagaaaccatcacgtataaagccgaaaacggcaatattaaaattccgaagcacccgaaacgggtcgtcgtcatggctgacggctactacggcgactttaaacagctcggcatcaatgttgtcggcgcgccgcaaaacgtatttaaaaacccttattacaaagggaaaacaaaaggtgtcacaaacatcggcgacggcacgtccgttgaaaaaatcattgacttaaagccggatttaatcgttgtctggacgacacaaggcgccgatattgaaaaactggaaaaaatcgcgccgaccatcgccattaaatatgacaagctcagcaacattgatcaattcaaagagtttgcgaaaatgacaggcactgaagataaagcagacaaatggctggctgaatgggataagaaaaccgctgccgctaaaacaaaggttcaaaaagcggtcggctcaaaaaccatctccatcatgcagacaaacggaaaagacatctatgtattcggtaaagacttcggccgcggcggaagcatcatttatgacaaactcgggctgaaggccacaaaactgacgcaggaaaaagccattaatcaagggccgggctacgccagcatttcactcgagaaactgcctgacttcgcgggagactacatctttatggggccatggcaggccggcggtgacgacaaaggcgtgcttgacagctcaatctggaagaacctcgatgccgtcaaacaaaaccatgtctaccgcattgatccgatcggcttctatttctcagacccgatctcacttgaaggccagctcgactacatcacaaaaagcttaacgaagtaaccccgaagccgctgtcacagcggctttttattacgcttaaaacttgacaaaaaaatttatttatgttataatttacatttttggattaacatgtataataagattctcccggccggagattgatgtaaataacggaggatctttatatgaaagaaaacaaggcgagtatgacttccctgctgtccgctttcggaagggcgtaccacagtaaatacgacaccccggtgatatttgatgattttatggcacaagatctgatttccgaaaaagagcattcggacatccgcgatcatctgattcaaggtatatcatttttcagtaaagacatggcacagaggcttcaaggccaaccggatgacatcttaaaatgggtgactcaagtacagctgtctcctacaccgttagcccgtgccgcatattgtgaagaagtgcttttgaatgaagtgaagctcggggccaaacagtatgttatccttggcgcggggctcgatactttctgtttcaggcatcctgagatgacaaacgtcttagacatatttgaaattgatcatcccgcttcacaggaagacaaaataaacagattgaaacatctgaatctcgacatttcccatcatcttcattttgtaccgatggacttcgccgcttcgctttctttcagccgtctgtatcaggaaggtttttcacgccaaaaaacctttttcagcctgctcggtgtgtcatactaccttacgaaagagcatctcgcccgcctgctcacacaattatttgccgaagtcccgccgggaagctctatcgtgtttgattatgcagatgagtcgctctttgaagaaagaggactgtcaaacagagtggaaaacatggtgaaaatggctgcagcaggcggagaaccgatgttatcgtgtttcagttataaagaaatcgaaaaaatattagaatcatcaggtctgcttatttatgaacatgtatctccggcggacgtcaatgaccgttttttcagcggacgcactgaccatttaaccgcatttgagaccattcattatatacacgccgtcaaaaagtaatccgctgttgcaaacaaaaaaagacatctcacagacgtgagatgtctttttgtcataccgatggtctgttgtttgcaaatttctttgagacgaaaggatataacagcaaaccgacgaaaaacagcccgataccgagaataaaggtcgttaaatcggccgttccggtaataatgacgtaaaaagaataaatgcaggcaaggatggcgatgataccgtctcttactcttgaaccctttatctcgtcatacgtttcacccgtaaaaatgagcttcaggctgtaaaacgctgacacgagatacggaatcagataagcgagcgtcgccgccgtcgttaaaaacgtaaacgcgtcactgatcgtccgggaaataaccgaaaagataaagatctgtgacattacgttcgttacgattaacgacacaaccgggcttccctgtttattcgtttttgcaaaagcagcgggaaagtctcctgatttcgccgcttgatacggaacttcagaaccgagaagaatccagccgagcatcgttccgaacagacacaaaattgccagaatcgccatgatgacgcttcccgcgctgccgacgatcgcgtacaatacgtcaacaaacggtttttccgagccgacaagcttaccatgcggaagcacgcccatcgtaatcaatgtcacgatgatatagatgccaagcgcgatcaataatccggtaatggtggcgcgtttcacgtcgcgctgcgaacgggcgcgcccggataaaatgactgccgattcaattccgacgaacgcccataatgttgaaatcgccgcattgtggatctgtccgccgattccctcaaccgtgtgaggacctgtttgaacaggaaaataaaaatgatcgaaaaacgacgtttgaaatacaaacaaacctgcaatgataaagaagataaatcctaatacttttgaaaacgtcgtgacgaaatttaatttactcgcaccgttaatgctggtgacgaggatcgtgtgagtgccccataataaaaccgtacatacggcaaacgtcagcagctggccgagcgtaaccgcctgaccgccgatcgaaaacatttcacgcttatccgttaaaatcgggaaaaatgatgttaaatatccggcaaggctcgtgatgatcgccacgttgctgatccagctcgccacccagtagccccacaccatcgtgaagcccgcagcattcccttttttccgatcgctgaacagcgcacgcgcatagctttgcggccccgccgtcagctcaggcttgcggatggataagtggccgaagaccagcgcgatcattaacacaccggctcccgttaaaagccatgccgatgtggcgccgaacgggctcgcgatttttgcgagcgtactcgggagcgaaaagatgcccgagcctaccatatttcctacgacaaacgccgttaataaccaaaaaccccattttttcgtctgttccattcctgtacctcctggttgttcattcgtacggaccagaccccgagaccatatttacacgcaaaaaaagcctgaacaaaagtccatgcttaaagaaacacacacacccttgatctccggatagccctccgcgaaaaagcacgcggcagtcctgcacttattcagatacagtcccagcataaagaaggatcggctttctttacacttcggcgctgatgcctttaacacatgttttgcggccccttatcagcctggcatgtgcgactcatcatcaagcgcaacctctacctcaccgagaaagagtgaggatttttatcattcaattctactcagaggttatcagagataaaaagatctgtcaaagggaaatattagatggaaaacggatagagcgttcgccctacccgtcttatatggtcagcggttgtttttttcttttgaacagcttcttgaagcggatcgtctttcagagctgcactggcgtcgtcaagcgcgccttgaatgacgtttttgtttttatcgctgttttttcctttttctttgttaaagaaagccatctgtatcacctctttatcaaatataggtacacctataatgtgtctttttccgcggcagaatatgcggaatccgcgtctccttccttttggcggaacaggtaaagtttgttgatcaaacatgcattctcttgatatatttgtaattcaggggattttggcaaaaataaaaaggagaagcgaaaaatgacaggaaaaacacacatcatgggaggcatcgcttcttgttccgcaattgcgtattattacgggtatgatccggtccttatgacctcagcgggtgccctcggggcgctgattcccgacatatgccatacgaaaagcaaaatcggcaggacgctgcccgttctgtccaaagtcgtaagcacggtgttcgggcacagaacgtttacacacagcctgctgtttatgcttattatgtttttcattacggcaacctatattccgaatccgagcatttccgccggactgatgatcggaatggcaagccatcttgtacttgacgcatggaccgtcaacggcattaaactgctgtttccgtccgccatccgcttccgtcttcccctttatatgagaacggggagcttttcggagcagcttgtgctggccggcttaacgattgtatcctgctattatttatacgaactggttcacggccgcatctcttaaacaaaaagcgtcttttcgcttttagggtgaggagtcatacatatgaagaaaacctttttcagcaatcatcggtttttatgcctgtccatcctgttcatgtggatgaaaacctatgccgtgtataagctcggtttcggtctgcagaacaattcggttcttgaggaatgtctgctccttattaatccgctgagcttcattgtgccgctgttcggcatcgccctcttgctgacggaaaaaaaacagcggatctttctgctttcggcaaatgtgatgctgacgggaattttaatcgcgaatacggtgttttacgggttttatattgattttatcaccataccggttttgtttcaggcaagcaatatgggtgatatgggaagcagcgtccaagagctgtttcacccgctttatatcgctttatttttggatattgcgattttgttttatcttggaaaaaggcataaagccgataaaggaaaagcgggcgcccgtaccgttaaagcgtatgcgtgggcatcagccggcctcatgctgtgcaaccttgcgctgtctgaggccgagcagccgaagctgttcaagcacccttttgatcgtgaagcgctcgtaaaaggaatcggcctgttccactttcatttgtatgacaccatttcgcagacgctgaatgcaggggctaaagcgtttgccgatgaagacagccttgcggcggtcgcgaattacactcaagccggctacagcaggccgtccgattcaaaattcgggcttgcaaaggggcgcaatgtgatctttgttacgctcgaatcaacacagcgttttgtaatggatgagcgggtcagcggacgggagattaccccgtttttaaacaaactgcgaaaaaaaagttatgacttcactcatttttatcagcagactgaacagggaaaaacatcagattcagaattcattactgcgaattcgctgtatccgtcttcaagcggcgccgtttttttcacaaaaagcggccaccggttcaatacgatgtaccatatgttaaaagaccgtcaatactattcagccgttctgcatgccaatcataaagccttttggaaccgggatgagatgtacggggcattcggaatcgaccgttttttcgacgcggatgaatttaaggtgacacaggaaaattcaacaggctggggcctgaaggataaggagtttctcgaacagtcagcggaaaaattaaagaagcttccgcagccgttttacgcaagcctgctgactttgaccaaccatttcccttttgaaattgatcaacaggatcagctcattgaggaaccggacacaagcagcgagttattaaaccgctatgtgacgacggtccgctatgaagatgaggctctgaaacactttttcaagaagctgaaaaaagaagggctgtatgacaacgcgatgatcgtcctgatgggagatcattacggtatatccgaagcccataatcaaggacttgccgaattcttagggaaagaggaaatcactccgtttgatacggttcagcttcagcgcgtgccgtttatcattcatattcccggggtgaccgaccgtgcgccggaaacgattgcttcggccgcgggacaggttgatgtaaggccgacgctgcttcacctgctcggcattgaaacgaaaggcagcattcagttcggcaatgatctgttttccggagagcggactccgtttgcggtgctgagaaacggcagctttatcacggatgaccatatttatacgaaaaatacgtgttacagccgtaaaacgggtgaaccgctttctgacatgagcgcgtgcagcgatgagaaagaaaaagcggaacaagagctgatgctttccgataaaatattaaacggcgacctgctgcggttttataagcaataaaaaaatccctccgttatatggagggatttttcatgtttcatatatgagccgtcctgtcattttcgtatcatatccggataattgagaaagctgagacttgaattcctcagaattaagaatgtcccgcacgctttgaacaagctcccggttttgttttaagacgaccacatcgtactgctcactgatcaccgggataaagtccgtgcctgccatatgcgccgcatgcagcgacccgactccgatatccgcctttccgcttgatacttgtgaagccgctgacagatgatccgtgacaatgtcatgatatccggcgacatcagacggcgtgatgccgaatgatctgagctgttcatccagcagcaccctcgcgcctgatcctttttcgcgattgacgatgcggacatcctttcggctcatgtcctgaaagccctgaatgttcagcggattgccctttttcacatataatccggcctgccgcagcacgacatgaaaaagcgcaaacggctcccctgaaagaatgcgcttcacatacgggatgttatactgccccgtctccccatcgtataaatgcagactgacgatgtcacaagccccgcggtacatctcgatcaggctgttcaaactgccgctgtacttgcggagcggagccgcctgtattgtttgttccagctgtttgctgaggaggtccatcgacacatcctgcccgctgatgataacagactgccttttttccggctcccgcccgcgtgacgggtcaggcgcttctgctgcggatggcttttttgacattctcatgtttgctttatattgttttaagtcctcttcatcgaccctcatctgtcttccgaccctgtacgccggaatgagtcctttttttatcaaatcatatactgtcagtttggagaccttcaaaaggcccgcaacttcttctattgtataggaagtggcttctgtcatattatcacgctccgtttttattataactgttcagatattgaaaaaaaaccgcaccatcacgtacaattgcgttataattagtttgatctaatgatatttagctataaggggtgcacaatgttgaaaaagaaagcgacactactcacaactgcggctatggccgttttcctcgcaactgcgggctgctcatccggacaatcgtccaaaggcggacaaaacgaaaacgtcacgctgaccgtttctgcagcagccagcgctcaggatgcacttgaagaaatccagaccaactacgaaaaatcacattcaaacgtaaccattcaagacaacttcggatcatcaggcacattgcaaaaacaaatttcacaaggcgcgggagctgatttattcttctcggcagccgaagataaattcgaaaagctcgttcatgacggagatatcgacaaaaaggacagcacggatcttttgaaaaatgatctcgtcatgatcgtgcctgagaaaaacagcgcacacctgacacatctgaatgacctgaaaaaagacagcacggaaaaaatcgcgctcggcacgcctgaatccgttccggccggacaatacgccaaacagtcactgacggcattatccctgtgggacaaggtaaaagataaagccgtctatgcaaaagacgtccgccaggtgctttcttatgttgaaaccggaaatgtcgatgccgggcttgtctataaaacagacgcgctgatttcgaaaaaggtgaaaatcaccgatgaagcaccggcgaaaacgcacgatccgatcgtgtatcctgtcggcatcgtcaaggatacaaagcaccgtaaagaagcagaagcgttttatcagtatctgcagtcagatgaagcgatgaaagtgtttaagaaatatggatttactgccaagtaacattacggcttcggagtttttcactcccgtcgtactgtcatttgaggtggctttggcgtcgggcatcgccgtcatcattctcggaacgcttgccggcgcctggatggcgaaagcgcgatttcccggaaaaacggctgtggagaccctgtttatgctcccgctcgttcttccgcctaccgttgtcggcttcattctcattatcattttcgggaaacacagctttatcggccgggcgattgagcggatttttcaccagcccgtcattttcacgtggtcggccgcggtgatcgcttcggccattgtcgccttcccgcttatgtatcagtccgctaaaaccggcttcgccgcggttgatgctgacatcgagggagcggcgaaagtagacggagccggcaggtggcaggtgttcacccgtatttccgtcccgcttgcctttccctccctcttgaccggaagcattctcagtattgcaagggcgctaggtgaattcggggcgactttaatgtttgcgggaaatattcccggcgtcacccaaacgctgccgacggcgatttacgtcgcgatggactccggcaatgaaacactcgcctgggtgtgggtgatctgtattgtgatcatttcttttctgatgctgtttttcatccaattgaaaaagcccgcttgaccgatctgccttccgcgcacctttcgccgggaggctttttgatttaaaatcggatggtatataatgaaacaaaaacacacaaagggtgcggctatgaagattaatgtcattatcgcggatgataattctttcatcagagaaggaatgaaaatcattttgcatacatatgaggaatttactgtatcagcaacgttggaaaacggactcgaggcggcagagtattgtaagcacaaccccgtcgatatcgccttgctggacgtccgcatgccggtgatgaacggcgtcgaagccgcaaaacggatcgctgaggaaacggatacgaagccgatgatcctgacgacatttgacgacgatgagtatattttagaagcaattaaaaacggcgcgaaaggatatttattaaaaaacaccgaaccggaacggatccgcgatgcgatcaaaagcgttttcaacgggcacagcattcttcaggacaccgtgctggacaaaataaaagacagccttttccggccggcggaagccgcgcatcagattgatgaaagccagtttactgaaagagagctcagcatcatgtcgcttattgcgaaaggattctcgaacagggaaatttcaaaacagcttttcatttctgaagggacgacggccaattatatttcatctattttagggaaaacggggcttgagcacagaacgcagatcgccattttttatatcaccgggaaggtggataacgggcgttgaacggtatggatttttggatgctgatgagcagactgatcgctattttttatacggcttttttgttcgtatcggtagaccgcccttacacgccgtacgccgtcttatttctgctgctttatctgtctttgggcatcgcggtctgcatgatcaggccgcccgcttggaggcgcgggatcaccctcatgacgctggcattgaccgcttggctttccgccttaggccatccggcgtttctgtttcttttgccgcccgccatttttgcggttcttgccgaatatccggttcaccgctatgtgttctgcctgctcgtgtttttgccgtttttatttatcccgtacggcgaccttccgacttatatcgtcataaccttgttctgtctggcgattttcgttttggccgcccggtccggcaatcggctgaagaaatatgaagaacagtcggacagcatgcgctcaagcattgaaaaactgacgaaacagctgcacagcagcacagaatatatcaaacaatcggagtacaccggcaaactcgaggaaagaaacagattgtcccaagccatccatgacaaaatcggccattcgatgaccggcgcgctcattcagatggaagcggcgaagcggatgctcggctcccatccggacaaagcggctgaactgctccaaaacgccattaccatttccaaagagggcatagaggatatccgcataacgctgaaaaatatgaaaccgcccgctgaacaaatgggcattcacagattaagaacgtttattgatgaattttcggccaaaaacgggatgccggttccgtttacgcatcaaggcgatttggacaggctgacgcaaatgcattggagagtcattcaggaaaacgtaaccgaagctttaaccaatgcgatgaaatacgccgatgccacgcagattttcattgatatccatgtgctgaataaagccgtgaaagcggaagtgaaagataacggaaacggcgccgtccgctttaaaaaaggcctcggcatgctcggtatggaagaacgggcggccgtcctgcacggaaccgttatttttgacggcacggccggtttttccgtcacgacattgcttccggttgaataagtgaatgttttcatgtgaaaaatatgaagattctcatgtcaaaggaatgaacagctgcactaacggccgttcattcttttttttataataagagcatcataagacatagaggtggaaacatgaacattttggagctcaaacagctgagtaagaaattcggtgattatgccgccgttgaccagatgtcgcttgccgtaaaagaaggtgagattttcgggtttctcggcgcaaacggagccggaaaaagcacgacgatcaatatgatctcaggtcttttaaaaccttcaggcggagacattctgtttctcggaaaagatattttcaaatatagcaaagcaacgaaaatgaatatcggcatcgtccctcaggacctcgcgatttacgaggaattaaacgcctatgaaaatgtgaagttcttcgcaggtctgtacggcctgagaggggcggctctgaaagaacgggtcgaggaagccctgacattcgtcggcttgagcgataaacacaaatatttgccgaagcatttttccgggggaatgaaacgccggcttaatatcgcctgcgcccttgcccaccggccgaaactgatcatcatggatgaaccgacggtcggcattgatccgcaatcaagaaattatattctgcaatcagtgaaaaagctcaatgaaatgggctgcacgatcatttacacgagccactacatggaggaagtggaagaaatatgcacacgcatcgccatcatcgaccacggaaaagtcatcgccgaaggcacaaaagaacagctgacctccatcattaccgacacgaaggacgtcgtgattgagctgtcatccggaaacggcatcagcctcggcgatattcaggagctgcccggcgtcagagccgccgcactggaagaaaacagcgtgaaaatcagctctgacacaggggtcaacaatttaaaccgcctgatccggtacttcatggacaaaggcattgaaatccgctccttgcaggaacaggcacctgacttagaaacggtatttctcacgctgacaggcagaagtctgcgcgactgaccctattgaaaggaggattgcaaatgaatattctgcacatcgccgggaaagaaatcaaaatcagtttccgcgacagacggacttttattttcatgcttgcttttccgatcgtcttcatgctgatttttaccgcggcattatcaaacgcctttgattcagaggtgacggtcgggaacatcaaggtcgtatatacggaccaatcaaacgggacactttctcattactttactgagtttatgaaaaacgccaaaaaagagcatgtctattttcaaaaagcggacacggaggcaaaaggcaaaaacgaggttcgtgaaaatcaggcggatgctttcgtcactgtaaaaaacaccggttttcaagtctatacaaatgaccggagcggcatcaacggcacgatcgtccaaggcatgctgaccgcttttaccaatcaatacaaagcaggcgccgccgcttacaaggcgcataagccaccttccgccggacaaatcaaaagcgattatatgaagcagacgtctttacacaaagcaaaagaaccgaaggcgaaagatttttacgcgatatccatgacgacgatgatcgggctgtacgcctcgatttttgcaagctccttattccgcggggaaagaatacggcacaccgcggatcgcctgatcgccgccccgctccggaaaagcgatatctttcttggaaagatgctcggcattttggctgtgaatgttctgacgattcttgccgttgtcgccttcagcaaatttatcttgaaagcgaactggggcagccacatgggacttgtgctgttgattctcgtttctgaaattcttttggccgtcagcttcgggctcagcctgagctatttgaccagaaaacccgaaagcgccagattaatcaccgtcatcatcgtgcaggtgatgtccattatcggcggcgcctattacaaatatgaaggagggggatttccgccctgtcgcccttatcctggatcaataaggcgattaacaacatcatttacgcaaatgatgtatcagcggcatggcctgcactcggtttaaatacagcattggcggcactctttttgctgatcgccgcatttacgtttcaaagacgggagggactgtaatatgaaaaacttctggtggctgtttgcacacactctcaaaggaattacaaaaagcaaaaaacagctcattctttatatcggggctccgctgatcggcgtcttcctctccttcatgaccaatgccaacggcggagccgaaacgctcaatatcggcattctcgatcaggacggcggagaagtggcacaggatacggtcacgtttttaaaaggactggatcatgtgaagatttcggaggaaacggatgcgtccgcctcatcaaagatcgcttcaggaaaaatggaggcgctcattacgtttgaaaaaggcttctcccaaagcgtaaaagacgggaaaccgtctcacatcggcatgacctcgctgaagggcgcccaggtcaccggatatgtcagctcttatttgtacaattatatgaacagcgccgcctcaatcggcaaatcttccggcggagacgagaaagcctttcaggcgatgtacgccgatttcaagcattctccgattcaaacggagtccgctgttttgaaagatacttcgaaccataaagaaatgacttactcagtcatcgggtatctcattatcattatgctctattccgccggcaacctgacggaactgatgattaaagagagagaaaacaggacgtactacaggcttctgtcaacgccgatcacgtcaaagcagtatgtattggcgaatgcggcagtgaatatcattatcatggccgtccaaattatattcgccgttctctttatgggcgccgcttttcatattcatccgtcattcccgctgtggcagctgttcgtcctgatgatgctgtttgcattaagcgcaatcgggatcgcctttattgccgtcggtttttccaacagcagctcttcggcatcggcgcttttgaacttgatcgttgtaccgacatgcttgctcgccggctgcttttttccgggcaatattatgccgaaaacagtgcagacaatcgccgaatttctgcctcagcgctgggtgcttgatacggtcgatcaattgcagcacggccgcacgctccaaagcctgacgctgaacatcatcattttgggagccttcgccgccgccctgttattaatagccgcatacaggttcagcgtaaaacgtcagacacagacatttatgtaaagaaaaacagccccgtaaagggctgttttttcttagaacagaagctcgtccggattcgggccgacacgctcgtctttgttcaatgcgctgatcttttccatttcttcctgtgacagttcgaaatcaaaaatatcggcattttctatgatgcggtgctctttaatcgatttcggaatggtaacgacttcgttctgaagatcccagcgcaaaatcacttgagcaaccgatttgttatgtttttccgcaatttgtgacagcacttcgttatcgaggagctgtccctgcatcaatggagaccacgcttccacttgaatgccctgcgctttgcagaaatctcttacttctttttgagtcaggcgcgggtggaattcaatctggttgaccatcggcttgatttcagcatctttcagcagttcttctaaatgatgcacttggaagttgctgacgccgatggcgcggattttgccgtccttgtacagcttttcaagagcgcgccatgtgtctttatatttatccttgcccggccagtgaatcaggtaaaggtcgaggtaatcgaggccgaggcgctcaaggcttttctcaaacgcgtcaagtgtcgtttcgtatccttgatcttcattccacacttttgacgtgatgaacagctcttctctggcaacgcccgcagctctgatgccttcgccgacaccctcttcatttttataaatagccgccgtatcaatgctgcggtagccgtttctgattgccgcttcgacggagtccgccgctacgcttccgttttccaccttgaagacgccaaggccgaaccacggcatttcaacgccattatgaagctttacagtatcttttaagctttttgccacgttgaaccatcctttctagtcattatgtaaacggttattattatctcacatttccgccgtaagaaaccaattatacgctcatcgttatcacaaaaaccatctttagtgcccaagcaccactgacgttattattttcctatttttcaaaaattacggttaatcaggtaactgtccgggtaaatcgctactgtagccaccacacaattgaaggaggaaatcatatgaaacgtatgcgtatcccgatgtccgttgcccttggcgccgctttgtctctgactcctctgtcctttgtatccgcaaaagaaaacccggcccctcaaaacatggctcagcaaacatcagatgtctcagcaaaagatgtcggattaaacattgacgttgacctgctcggcatcggcaattcgattgctgacgcgattaagtcggcgcaaaaccgtgacggcttcgtcaaaaacttaatggaatcttcattctacgcttccggacaaaaatataatgtcatggtgtttaatttaagccaggaatatgaagatcattttaacggcgttcagttttacggttccgccgtttatgacggcatcacgtacggcatttgggtgtttgaagacggaagcttcaccaacaaaggagatggcggctggatcaactgggccttcagaggctggtttgaccgcgacggcgatcacgtcgaattccatcgtccgtaatctaaaaaagtccggcgaacagatgccggactttttttattcatctccgtcaagcatggccgcttccacatcattgatgtattggcgaagctcatgcgacatgtcgcgggaaatttcccgctcttcgaataatgtttggatttcgttgcggatggcctgcacggcccgcagtttgatttcgagtttttgattttcaaaacggcgactcggactctgttcgtgatacgagtgccccagcctgaaaatcaagtgattgtaaaaggaaatgacggcaagcgtcacatctttattttcttcagtcatgtgttttttcaggctttcaatggccgcttttgccgttttaacccttgtggagcgaatgaggccttcttcatttaaaatcgacatttccggttttttatgttcgccgaaaaagatccagtacatcaggcgtttcagctttttcttagataagccgactttaaacgggttcgtataaagcacttccagttcatcaaaccgttcctgaaggctgtcagccgtttcttccggtatgtcgccccgctcaatcagccgcagcaattcttcctgttctgcctgaatcccttgggcgcggactttccgctcatcttttttcgtgcggtttttgacggtgaactgctgaaacctgagatttttcattttctcattgtattcggcaatgaccgcaaaagaagccgttttgtttgactcattcatattttctttaatggcggttaaggcagcctttatcagcttccgtctcgctgtcagcaatttgactttcttttctttcacattgtcttccggcttatctgtcaaaatcggcagaacgattgtcgccagcaccaatgtgcacaaaataacgcccgcggctaaaaagagaatcaaattccgttcaggaaacggtgagccgtcagagagcacgtaaggaatggaaaaggaacccgcaagcgtgaccgctcccctgacgcctgaaaccgaaatcagcagggtcgagcgcaggccgggtttataaatgctctgatccttgttaaaaaaccacttgccgttccaaaaaaacagcacccacaaaaacctgagaatcattaacgtcagcgtaatgacgataatgtacccgatgaccatcatattgttaaacgcggtatcattaaagatgacggaaaccacatccggtatttgcgcacctaaaataacgaaaacaagaccgttcagaatgaacaaaataatattccacgtacttgaagagacgatttgcagtttgaccatcgttgattcaagacggtcctgctccaccgcatgcgtgatgccgccggccacaaccgctaaaatgccggaaacgccgatttcttcagccgcgagatagatgacgaacggcgtcagaatttgaatcagcatatgcatcgtgacatcctgcatgccgaggcgccgcataaacagccggaaacggataatcaaaaaagaaatgacgacaccgctgagtaaaccgccggctgaaatcagaacgaaactgaacgcggcttgcgccagcgaaaatgcgcccgtcacggcagccgcaatcgcaaatttaaaagcgaccaggccggatgcgtcattcatcagcccttctccttcaaggagacgcagaatgccttttggcatcttcacacgccctgacagcgcgctgaccgcgacaacatcagtcggtgacagaatcgccgccagcccgaacgcggcggccagcggaatgctcggaatcatccaatgaatcgtgtaaccgccgacaatcaccgtggcaaacacaagcccgagcgcaagcagcagaatcggcgctcttaaattccaaagttccgcacgcggcgtccgttttccatcgttaaaaagcagcggcgcgataaacaaaacaaaaaacaattcagtattcagttcaaaatgaagcccctgcggaaatgacgccgcaatgataccgagcgccacctgaatcagaggcaccgggataaaggggacaaaccgatttacgatatttgagatcgcgataatggttaaaagtacgagtacgactaaaaatatgtccaaagctgacctccttcatctgctgcatcatatcattattgcctgttctctgcccttgtcaaaggccggagccgatgatcgggcagattcaatatattttccgcacgcaaccattctccttttattttacccgtttttatttaaaatttctcataacgcgctcacggcgaactttttttgccttcagctacattttttccggaaaaagaaaaagcctgttttctctgaaaacaggctttttcgcaagctgcgtcatctgtttcatgacgcggagcagcgtttatgctgcttagtaaaggatagagaacgcaccgccagtgtgtctctatccttggttttaagagctcatcttattcgtgaaaattcgtgccgtctgtcgtcgctttaatgatgccggcgcggatgacgaaatcgccgaagtgttcgccttcctcacgctctttcgcgtagcgcgggagaatggtgcgaagctcattcagaatttcctcttcaccgatattttcccggtacattttgctcaaacggctgccgtcaaacgccgctcctaaatacatattatattttccgggcgcctttccgataaatccgatttcgccgagtgcatggcgggcgcagccattcgggcacccggtcatacggatggtgatttcttcatcccggagcccgttttcgtcaacaatgtcttcaatcttatcaatcagcttcggcagataccgctcggcttcggccatggcgagcccgcatgtcggaagcgcgacgcaagccattgaactgcggcggagggcggaatgctgccagccgtctgtcagaccgtattgttcgattaatgcgctgatttgtttctttttctggctcgagacattgccgataatcaggttttgattagaggtgagacggaaatctcccgtatggactttggcgatttcacgcaatcccgtcatcagcttataattctcatagtccgtgacgcggccgccttcgatgaacatcgtaaagtgccatttcccttttacgcccttcacccatccgtaacggtcgccgttatggtcaaaatgataaggtttcgcttcatccagctgccagccgaggcggttttccagctcggcttttacgttttccagcccgagacggtcaacggtgtacttgaatctggcattctttctgacggaacggtttccgtaatcgcgctgaatcgtaatggttttttccgctacatcatacagctgctccggtttgcagaagccgatgacttttgaaagctgcggataagtggccgtatcgccgtgcgtcattcccataccgccgccgattgccacgttgaacccgataagacggccttcctccacgatggcaatgaagccgagatcttgagaaaagacatcgatatcattggacggaggcacggcgattccgattttgaatttcctcggcaaatacagcggcccgtacatcggttccgtttccgtgtcaggagttcccgccacacgttcctcatcaagccagatttcatgataggctctcgtgcgcggaagaaggtcatcgctcaatttcttcgaccattcgtatacttccgcatgaatttcagactggtgcggatttgaagcgcacatgacgtttcggttgacatctccgcaggccgcaatggtatcgagcagcgccgcattgattttctgaatcgtttttttcatgttccattttaaaattccgtgcatttggaacgtttcacgcgttgtcagcttcaatgtattgtttccgtatttttgcgccagttcatccatgacaagccattgttccggagttgacacgccgcctggcatccggacacgcagcatgaactgataagccggttcaagcttttgtttttgacgttcattacggagatcgcggtcatcctgcaagtagcttccgtgatgcttcatcagccggttgtcatcgtccgggatgccggctgaaatccggtcgagcatgacttctttcaatgtgccgcgcaaataatcgcttttttctttaatttcctcaacatcacttggagggccttccggcgcttttaaaatgttgttcaccatgctgaataagctcctttcaaaccaaaatcaatatacgtcacgctgatagcgttttttctgctgcatgtctgccaggaagctttccgctttttcacggctcatgccgccttcttcctgaatgatatcgagaagcgcctggtgcacgtcatgcgccatatgctgttcatcaccgcagatgtatacggcggctccctgctgcagccattcatacagctctttgctttgttctttcatgcggtgctgcacatatactttttcctccgaatcccgggaaaaagcgacgtccatttttgtaagaacaccgttttgcagccatttttgccattccgtctggtacagaaaatcagtgacaaagtgctgatccccgaaaaacagccatgttttcccttcagctccggtttcttcacgctcctgcataaaggaacggaacggtgcgatgcctgtccccggcccgaccataatgatcggtgtatccggattttccggcagcttgaagttttggttgtgctgaatgtaaatcggaagcgtatctcccggctggagtctttccgcacaaagaatgctgcagacgcctttgcgttctctgccgtgcgcgtcatatctgaccgctccgattgtcagatgcacctcttccggattcgcttctaaactgcttgcgatcgaatagagccgggccggcattttacgcaggatcgaaagaaagtcttccgcggaagcttcccacggaccgaaatcccggacgagatcaagcagatcacggccgttggtgtatgctttcagctgctcttcgtttccttcggccagaagttcactcagcttttgatcagccataaactgtgcggccttttgcaaaagcggctttgttaagacggtaatttcaaaatgagaagtaagcgcgtctttcagcggacggcgctctccttgtttattcaccgccacttcctgttccggattccatttcagctcattgatcagctcatcaacgagcgccggatcattttccggatagatgccgaggctgtctccgggctgatacgcgaggcccgacccttcaagcgaaagctcgagatgacgtgtttctttatttgaaccgcgtccgttcagattgatgttctcaagaacctccgcccgaaacgggttcgttctggaataaacggattcaccgagagcgggcgtctcggcaggcgcttcggctgtttgatttcccgctccttcgttcaaaccgccgatgaccgcttcaagccattccgaaaacggctcatcataatcaagatcgcaatcaacccgcggcgcaagctgggtgccgccgagctcttgaagacgctcgtcaaactctttgccggtctggcagaaaaattcatacgagctgtccccgagcgccaaaacggagtaacggagctcttcaagcttcggcgcgcgtctgccgtgaagaaagtcatgaaaggccagcgcgttatccggcggatcgccttctccgtgtgtgctcaccacgatcagtaaattgtttacttttttcagattattcggcttaaaatcgttcatcgacgcgacggtgacctggaatccccgttcctcaagcgtctttaccgtctgtttcgcaagaccttccgcatttcccgtttgcgatccgtataatacggtcacttctttcgagactgccgggctttcagcaggagcctgagcagcgggcgcggctgtttcaccggattcggaccgggccgcagccaaatagccgctcagccagattttctgtgattctgtcaaggtcggcagaaggcggttaaggagctctgcctgctcctgattaaacggactgttcatgacctgaagttgcaacgatatccacctcacaaggaattaaacgtaacgtacgttatttctataggaattgtcaaaataatattctaattgaaactttaccgaaagtttgtatgtaagtaaaatatataatcatgatgacaacgattaagattactaatgataaaaagccctttgcactcagcaaagggcttatacgaataagccggcgggcacttcttttataaaaggagagggttctcccggagacaatacggtcaaatgatgcatcgcccgcgtacaggccgtatataacagcttacggtcatgttcgctattgtactgggcagcagaggcgtcagcggcgatgacggcgtcaaactcaatgccttttgccaaataaacgggaatgacgcatacccctttttgaaaaggctggttttctttattgattaaacggacaccgctctcggcgctgaccgcctgaaacacttttttggcttccgcggccgttttgcagatgacggcgaccgtctcccagcctttttgtctgagctcccggattgtatccgccaattgttcccgccgcgcattttctgtatccgtccgcaaaacacgcggtttttccccgttccggttaaaaggctcaatgtcatcgccgtcagccagcagcgctttcgtaaattcaacaatctgccgcgtcgatctgtaagtccgcttcaggctgacatacttttctgcaccattgcgaaagcagccggcgagggaagaagggcccgtaatggtatgggcataaatcgactggctgacatcaccgagcaccgtcatctttgccgccgggaagatggtttgaatatacgtgagctgaaatggggaataatcctgcgcttcatcaatgaagacgtgcttcatttgtgtgttttttctttttccttctaacagatcctgcaaatacagatacggagcggcatcttcatacggaagcgaccgttctgcaaatgcgtttccggtcaaagcgccgatgctctcccaatgatcgggcttttcatcagctccccagtctgaaaacagccggagatacatccgttttatatcgagaaagccgagccgtctgacggcctgcttaatcggtttaaaggctttgccgacaataatggcgccaagcaggcgctgttcgcgctgatggtcgtcaaatgcaggttcatcatctgccgcctgcttcttgagtgtttgataaacctcagcatagtcttccttatcaagcagctcgctctcctgcaagacccattccttcttacgctcctttttttcgagagcgctgatttccgcgagaagccattccgccgtcagctccgctctgttcggaatcggcagctgctgatcaagcgaataaaaataggcttcaatccgctcttttgaaatcaggatgtctccccggaagctgatctgtttacatttcaggcccgagaccgaaagcgacccggcatagcggtcaatcatggcctgaaaagctgatgacgctttgtaagcaatggctgcgagccttacggaaagtgcgtccttattttgttcagtcaggcaatattcaagctgctcgtacgggctttcacaatcaaactttcgtccgagccggcggatgatatattcctgaaaggtggcctgctccatattctcttctcccaattccggcaatacggcggacacataactgttgaacaaaatgttcggggaaaacaatacaatctgacgggcatcaagcaccccgcgcccgcggtacagcaagtaagcggcccgctgaagcgccgcggatgttttcccgcttccggcggctccctgaacgatgagatatttgcttttttcatcccggatgatttcgttctgttctttttggatggttgacacgatgtttttcatatgctgtccggaatggccgctcagcacctcttgcagcatttcgtcaccaatcgtcatatccgtgttaaacatcgctttaagcgtcccgtttttaatgataaactgccgcttcagtgtgatgtctccctctatcgtttcttccggaacttcatagcgggcttttcccggggaatattgatagtaaagagatgagatgggcgcgcgccaatcataaatgagaaattgctcgttgttttcatccattaaagaagtcagcccgatataaatccgctcggaagaggactcccctttttccgtaaaatcgacacggccgaagtaaggagaggttttcagcttttggattttttgaagctgccggtattgaagccgatgcgtccgttcacgttctgaaagcatttccgcctgctgtttaatgcttaaaaatgtctcagccgcttcgtgggcatcatccatattcacggtgacatcatcccaaaacgtttttctcaggccgacaatatcctgcttcaatccgcccgatgaggcttcaagatgagtttgtttctgttccagttccttcatgacaaaattgattctttcctgctcttctttccactctttatcacgttttgccatcagcggcacctccgacatcaagctgacaagtccggctttcatcatacaaacatatatgcaacatattattcagcattatggtcaaataccctttttcttatcatatcgggcgtctttttttatcagaagccgttatgcaaaaaaaccgatttcgtttgtgaaatcggtttttttactgttctatatgataggaacgaatcggcaggcgccacctgaacacataactgcagatgcggcatgccacaagcacaagaaacagcacatacaaaccggcggcatccccggcccagccgaggcccacgattaaccctccgagcgcggcccagactgcataaatttccgccttgagcacaagcggctttctgcccgcgagcaaatcccgtatgatgccgcccccgctgccggtcaggaccgctgccgcaatcaccgcactgagcggatggcccattttcacggcatataaagcgccttggatggcaaacgccgaaagcccgatggcatcggataggttgccccatttactccaatgccttaacagcagcttcggaaacaaaaagacaatcgtaactgatgcgagagcgatttgaaaaaacgcgccttgctcccacaaggcggagaccggaacaccgatcagcaggtttcggatggctccgccgccgaacgccgttacaatccccaagatatacacgcctaaaatatcatactcctcttccatcgcaacaatcgctccgctgaccgcaaacgcaatgatgccgattacactaagcagctcccaggccattccatatgctcctttttatttgttaaattttctgacgaccattagattttataatcgctttctcttaaaatcaaccttatttttgaaagattctgattcctgatccgggacaacctcatccgcaacggctgaaagcaagaatattttcctattttatactttaatggaaggtttattggaagtttcattgaatactttctctaacaaaaagggggttatgagatgaaaatcagttcacttgtttttcctgttttattggccgccggattaattcccggcctgccgtcagccgaaagccatacgcattcgcacactcatgcggagccggcgaaaacggtgtatacggacccgcttccgaaagccgatcattttaaagatctgaaaggcccggtccaagttgaacagacggttgacacaaaaattctggatgagaacggcaagcaggccggcacgaaacgattcaatgccaatgtcagtcaggataaagcctcaactaaagccagcacgggctcccagaaggtcagagtgctggcggtggcggacgctgaataccgcgccaaatacagcgactggcaaacgcgaatcgtccagatcgtggagcaggcggatgtcgcttttaaccgtgatcacaacattgatttcgtcgtacaggccgtgcaggcttggaattcttccggctcaaacagttctcagattttatcgaatctccaaagcagcttcagaaatcaaaattatcattttgtcgtcggttttaccgcaaaatcgagttttgacgccggcggtatcgcgtatgtatataacggcaaaccgagcggcccggctttcagcgtgaaccttgatcaaggaacggccaacacggcgaaagcggcacagcacgagttttcccataacttcggacttcagcatgacgcccaaggcagcggcatccgctgcgtcatgaattatgattatgcctattccgtggatatttgggacagctcccataacagacagattgcgacaaacaaagcttggtacaaataatagaaaaagagccgctcccatggagcaggctctttattttgccgtgcgttccgttttgacaaaacacatgcagataataatgagaataaatgccgtcaatgccaagaaaggaatggtaatgaaaccgaaccagttaatatattcagatgagcaaggcacgccgtagacacacggcttgatgccgctgaaaccgggcaccttctgctcaaggtaatgcatggtcgatataaatgcgccgatgacggccatcggcagcacatattttttcacgcgcgtgtcaccctggaaggtggcgattcctaaaatcaggacaagcgggtacatgagaattctttgataccagcacagctcgcacggtatgaattttctgatctcgctgaaataaaggctgacgagcatggcagcaagagctatcacccaagaagcatataaaaacacgattctatttttcatttttcagctctttcttaatcgtttttgaaatctcatcatatttagagaagtcattaatcaccttgtcatttacataaatcgtcggtgtcgccgtaatgtttaatttatcattcaggtcagtgtcagctttcagctcttttgcgaaggtttctttatcaaggttttccttcagcttgtcaggatcaacctttttcgcggtgcttttgaccgttttttcaagcaatgcaggcgtgacccattcctgttcgcttgacggctgctcttcaaacagcttctcatggaaagtccagaatgatgccgggtcttccttccacacctcttctgaagcaagagccgccagacgcgagccgcttccgtggtacatgacgttcacaaatgaaaatttcacgtcgcctttatcgataaaatcttttttgattttcggaaagatatcgctgttaaatactttgcatgacggacatttgtaatctccgaattcaactaccgtaacaggcgcgctgtctttgccgagcacgggctgtcctttaatggaaggctgttcggcgactgtttcgcccgctttttccgtttggttgttaataattacgatggccgcaaataaaacgacaacgattaacgtcagaatcaccgcaaatttcgcagacgattgtttctttttcactcagacacctcattgtttttaaaataaaaaagaagcggatgccggatggcccgcttctctattttaccaagacaaccttgtttaagaaaaccctgaaaaacgaattatctttgacaattattccgctttcactctcatgacgcgcatcgcgttggcaacggcgatcagcgtgacgcctacatctgaaaagaccgcttcccacatggtggcgaatccgaatgcgccaagcaagagaaaaatgatttttacgcctaaagcaaatccgatgttctgccagacgatccggcgtgtgcggcgtgcaatccggatggcttcggctgcttttgacggctggtctgtcatcaggacgacatcggccgcttcgacggcggcatcagaaccgagagcccccatggcagctccgatgtcagctctggcaagcacaggcgtatcattaatcccatcgccgacaaacatcagtttttcattcggtgaaagcgccgcttcaagttcttcgacgcggtctaccttgtcacccggcaaaagctctgtgtacacgtcatcaataccgagctcgaggccgacagcttctccggtctgctttgaatcacccgtcagcatcactgtccgcttcacgccgagcgcttttaaattggcaatggcctgtttggcgtcctctttgatttcatcggcgatcacgattgcccccgcatactgctgatccacggcgacataaacgacggttccgttattttcagctgtgccggaagcgatttgttcttttgccagcagtttttgatttccggccaaaatcgttgatccgccggttttcacccgaatgccgtgtccgggtatttcttcatattcttcaatctcctcagccgcgagcggttgattgtaagcttcgcggatggaagaagcaatcggatgattggaatggacttctgcaagcgcggctgcatgaagcaggctgtcattcgtaaatcctgccgccggtttgatatcagtaacggcgaaattgcctttcgttaaggttcccgttttatcaaacacggcgtatgccacctgattgagcgcttctaaatagttgctgcctttcacgagcacccctgctttagacgcagccccgataccgccgaaaaacccgagcggaatggagacgacgagtgcgcacggacaagaaatcacaaggaaaatcagcgcgcggtacacccagtcggatagcgcggctgaaggcacgagaagcggcggtaaaaaggcgagaagcaccgcaacaatgacaacggccggtgtatagtacttggcaaacttcgtaataaagttttccgttttcgctttgcgtccggccgcattttcgaccagattcaatatttttgacacggcagagtcttcataccctttagaggtttcaatatgaagcacgccgttctgattcataaatccggccatcacctcttgccccggctccgcttttctcggcacggattcgcccgttaaagcggatgtatcaaccatcgaggaaccgctcagcacctttccgtccagcggaatccgttctccgggattcacgatgatgacctgtcccactttgacgtcctgcgggggaacggcagccatgccgttttccgttttcacattggcgtactcaggacggatgtccaataacgcgctgatcgattttctggatcggctgacggccgctccctgaaacaattcaccgatctggtagaacagcatgaccgcgacgccttccggatattgatgaatgataaatgcgccgattgtggcaagcgccatcagaaaatgctcatcaaatacctggccgcggacaatattttttcccgctctggctacgatatcgccgccgatgatcaaatatgaagcaaaaaagagcagaaactcaaggacggcgcccgtgtgcgcgaagtaagcgatgacggccaaaacggcgcccgccgccaatctcactaacatcagctgcagctttttgcggtattcatcctcaccgggtttgtcttcgtgcttcgaacgaacggtcacatgaggatcaatggactttacttttttcgcgacttcatctttcatccattgctcgtttttcccgccggctgagaccgtgatggtgcttgccgcaaaattgacagcacagccgtctatgccgtcaatggcttttacgccgttttctattttttttgcacagttgctgcaatcaagtccgtctaatacaaattcacctttggctgctttcattttcgactcaccctactttccgtaataggattcccataacatcaatacaggtaaacgaatttatatatatgagcatatactcatataagtgttttctctattatatgcaggctttgaataaagtgtcaataaaaaagacaaaaccggcatcagccgattttgtcttttttcaccttctgtaaacgcaaagcattaagcacgaccgataccgagctgaacgccatggcggcgcctgccacccacggagccagaaagccggctgccgcaatcggaatgccgatgctgttgtagcccaatgcccatcctaaattctgcttgatgtttctcatagtcagccggctcatgccgatggcgtcggcaatgccgttcaggtctccgcggatcagcgtaatgtccgccgcttccattgcgatatcggtgccggtgccgatggccattccgatatcggccacagccagcgccggagcatcattgatgccgtcaccgaccatcgccacgcgccggccttctttttgcagccgggaaatttccgccgccttttgttcgggaagcacttcggcgatcacgctgccgatgcccgcggcttttgcaatggcttccgcggtctttttgttgtcaccggtcatcatgatgacgtcaagccccatatcattcagacgtttcaccgcggccggagatgtttctttaatggtatcagcgactgcgataagccccgccgctttgccgtctgccgcaataagcatcaccgtttttccttccgcctccaagcgggccatttgcggaagcagcgcttcatgttcaatatgctctgattccatcagccgtcttgatccggctagaatcgttctgccgtcagcctctgcatagattccggaaccgatccgggcttgaaaccgggtgagtttcgggatggaaatcccccgtttttcggctcctgacacgatggcttctccgagcgggtgctctgatcccgtttcggcggccgccgccagccgcaggagttcctcttcgttcattccctctgccggtacggcatctgtcagaaccggtctgccgtttgtcaccgttcctgttttatccagtacgattgtcgtcagacgctgggtcttttctaaatgctcaccgcctttaaagagaatgccgaattcagctgcacggccggagcccgccataatgctcgtcggagtggcgagccccagtgcgcacggacaggcaatgacaagcacggcgatgaatttgccgatcgcttcagaaaactgtcccggcgccgcccatacataccaaatgagaaaagtcagcacggccagccccagcacaatcgggacgaaaatgccggaaatgtgatccgcgagccgctgaatgggggcttttgatccttgggcttcttccacaattttaataatgtgtgcaagcgcggtatctttcccgacattcaccgctctgattttgagaaagccgtttgcattgatcgtcgcccctgtgacggtgcttccgggagacttatcgacaggcatgctctctcccgtaatcatcgattcatcaatcgcggaatggccttcaatcacttcgccatcgacaggaacgcgttctccaggtttcacgtatacgatatcccccgtccggacctcgtcaatcggaatcacctgtactttgccgtcccgctcaaccgccgccgtcttcgcctgaagcttcattagctttttaatcgcttctgatgagcggccttttgctttcatctctaaaagctttccaagcaatatcaaagtcagcaaaatggcgctcgtttcataataaagcccctcagcatgtccgtctcgcccgagagacgcaatcgtcatgtacaggctgtatgcgtaagcggccgtcgttccgagcgcaacgagaacatccatattggcgcttttgtttctcagcgccttgtacgctcccgtataaaaaggccagccgatgacgagctgcaccggggtggcaagcgcaaattgcagccacggattcatcaggatatccggcatccagataaaagaagtaaaagaaaaatggctgaccatcgaccataaaagcggaaaggagagaacggcagaaaatatgagcctgatcagctgctttcgctgctctttctccttttgggataatccgccgtctccatcaaccgctttcttcccgtctaatcggtagccgagttttgccacggtctctttcagctctttcggcgtcacctctttcggattgtattcaacggtgactgtttccagggcgaaattcaccggtgcgctcacaacgccctctgttttgttcaggcgcttttcaatccggttggcgcaagcggcgcacgtcatgccttcaatctgaaaatcggctttttccgtcacgacgtgatagccgagtttttcaattttatcctttatggcgccagcttcgattttgtcaggctgataggaaatatttgagatctcaagcgcaagattgacggaagcgtcattgacgccgtccatccgtttcagccctttttcaattcttgaagcgcaggcggcgcatgtcatgccccccacttgaatggtcatttctttcggttcactcaatgtcctcatctctcttcataaaccccacgagggtataattatgataaaagaaaaccgcgcccgttcccgcagcgcgataaaccttatacgacgtcatacccttgatcttcaattgcgtcttttatatctgatacggagactttgtgctcatcaaacgtcacatccacctgtccggcttccaatttcacctgaaccgccgtcactccgttcagttctcccactccggtctctactgcttttacgcagtgctgacaggacatgccttccacttgcagtgttttttgttccatgatgattccctccacgtcttgttttttcttttttatgttaccatacccctgtagggtatttcaaaacattttattttacgattttgcgatttttttcacaacatcaagcagctcggcaatcgcctgctccccgtttccgctctcaatggcgccggctacgcagtgatgggcgtgatcttccagcagatgaaacgcgactttctgcatggccgcctgcacggctgaaatctgcacgagaatatccacgcagtatcgttcgttctccaccatattctgaatgcccctgacttggccttcaatccgtttcagccggttcagaatctggtctttttccttggcgcttttatgatttaacgattgatgctcggtatgtttgtccattttccacctcggtttttttcttcgttatcttcattatacagacttgaaaatccggtgtaaaaaattttcaacacacaagttttaccagtacacccgcggggtatataatgttatcacatatcaagagggggaaattcattgaaaacgatacaggttggcatattgggatatggtttgtcgggtaaagtctttcatgcgccgcttttggacgtccttgatgattatcagatcaaaaaagtcatgacctccagaacggatgaggtcagacgtgatctgccgggggctgaagccgtgcgcgcgattgaagacattaccggtgatcctgacattgatctcgtcatcgttacgacaccgagcggaatgcattatgaatcagcgatgaaatgtctcctggcgggaaaacacaccgtcgtggaaaaaccgatgacggcgacttcagcagaagcggaggaactgagaagaacggctgaagataaaggcgtcttactgagcgtgtaccacaaccggcgctgggacaatgactttttaacgatacaaaagctgattcgggacggggcgcttcaagacattcatacatatcaagtcaactacgatctgtacaatccggttgtccaagaaagatggcgcgaaaaaagcggacccgccacgggaacgctgtatgatctcggttcacatattattgaccagacactcctgcttttcggaatgccggaatccgtcacggcacatgtgatgaaacagcgggacaacagtgaaaccgtcgattattttctggccgcgctccattacggcaaacttcaggtcattcttcaatccggctctatgaatgcggcaaacggcccgcgctatcagattcacggacggaatgcaagctttatcaaatacggaaaggacggacaggaagaggcgctttcagccggccaaaagccgattgacgacagctggggcgccgatgaccctgacaacttcggagagctgacaatcgcagcggatgaaaaaaggcatacagaaacaatcccctctgagaacggctcttaccttacgtactacaaactgctggcggacagcatcttaaacggaaaacagcttcccgttacggcaaaagaaggcatcgatgtcatccgtgtcattgaagcggcgatgaaaagcagcgagcaaaaacggacgattgccctttaatataaaaaacctcccagccgtacggcggggaggttttttttaagatcagaatgattttccggcttctttcgcgcgggcaatcgcatcttctttaatttgctgtgctttattcggttcagcattatggccttcaacgattaaaccgtcaaaagaaggaacgccgaagaagttcatcatgatgccgatgtaacggtggcccatttccatgtcagccgccgggccttcagagtaatagcctccgcgcgcctgaatgtggagcgcttttttgtcagtcaacaggccgatcgggccttgctctgtatatttgaatgattttccggctacagccacagaatcaaggtacgctttcataacaggcgggaatgagaagttccaaagcggtgtgacgaatacgtatttgtcagctgacgcgaattgatcgctcagctcgttcagacggccgactttcgctttttcgttttcagaaagctcttcaaatcctgtgccggattgaagttttccccagccgctgaatacatccgcgtcgatatgaggaatgttctctttgtaaaggtcgatatgtacaacctcatcattcgggtttgattctttataagaatcgataaacgcttttcctgtcgccatgctgtaagatgtcttttcatcatgaggatgagcagtgatataaagtacttttgccattgtaaacagccctttcgttttcaaattacacacacatttattatgaaatatgaatgtttttttatactgatcagttctgtaataattatagttacaaaaaattcttttcgcaacaataatatctcgaaatcagtatattttttaaaaaaggctgtaatgacgggaatggcaagcagcagaaaaagcagaaacatttagtttctgctcaaaatcggatttggtttgcagatcggaatatccaacccgagattcccccgcaatgtatccgccggatagctttttcggtacagcccctttttctgaaggatcggtatgacttgatccacaaaggcttcaagcatgcccgggatgtcagagtgaatgataaacccgtccgccgcttcccgctgaaaccatgtttcaattaatgatgccacacgttccggtgtcccgataaagttcgttcgcggaaacgcggcttcgcgcgccacttgacgcagcgtaagattcctggctttagcctctcttttgatacggtctgtcgtgctttgaaacgcgtttttcccgacgtcgcccaaatcaggaaacggctcatccagcggaaaacggctcaaatcataatcgtcaaaaaatctggccacatatttaatggcgttctctatcggtatcagctcggcgaattcctgatatttcgcttccgcttcttcttgtgaaccggctataatcggactgattcccggaaagatccgcagcttggaagcgtcgcggccgtaatccgccgcccgcttcttcacatcatcataaaaagctttcgtttcctcaagtgaattggagtgcgtaaagactgcatcggcattacgcgcggcaaacgaccggccggtttctgaagaccccgcttggaaaacgaccggctctccctgtttggaccggccgatattcagcgggccctccacttgaaaatactcgcctttatgatataggcgatgcagtttgtcaggatcaaaaaactgcccggtttctttgttgcggacgaaggcatcttcttcccaggaattccacagaccgcgcaccacgtccacatgttcttgagcgatgtcgtagcgccggctgtggtcgggaagactttctttgctgtgattgcgcgcggctcccgcctgcggagaggtgacgagattccagcccgcccggccgccgctgatatggtcaagagacatcagctgtcttgcgatggtaaacggctcagtgaacgaggtggaaaatgtgccgattaaaccaagatgggttgtagaggcggcaagcgccgataaaatagtgatcggctcaaaccgatttaagaaatgcgggatggacttttcagaaatgaacaagccgtccgcaataaaagcaaagctgaacagccctctttcagcagtctgcgctttttgcctgtaaaacgccgcattcgtgcttgctgtcggatcggcgtcgggatgacgccagccgtccgttgtgccgccgacaccgtgaatcatggctccgaattgaattagatccgtccggctcattttctctccccctttttcccctcgtaatcggcaagcgcccgttctacatgatcaatgccgacttgagtaacggcctgatacacacggctgtcaccgctgccgatttcaacgacggggacatgacggatgccgtacttcgtctgcagcacgtcacgcaattcgtcccgttctgtcacatcaattgtttcgtatgcaacggctttttcccgcaaatatcctttcacttcatcgcaataggagcagccctgtttgctccagaccactacgtttacttcatgactcatgttcatccctcctataattgtggggccggctgcaccgcttcgcttaacagccggtaagacaatcgtttttcctcagcgtttttgataggcgacaaaatcacaaaatcggtaatgctgtattgaacggataatcgtctcagctcggcggcggtctcttcttttgtcccggcaatcacacccgtcttttgtgtgatcagcttatatggctgcgtgacttgttccagaaacgcttccgcttgttcccgggaaccgacattcacctttttgccgtcttcgagaatgattttgaccgactcacgcgatacgacgtgtttttccgcttctgcttttgtatgcgcggtaaataccatcggcgcaaggtgaaattccgccttcgatcctttcggcagatgctcgtcaaaggcgtggcgcgctttttctaacgcagcctcttcaccgtttatgaaataggcgaaaacgaaggaaatgccgagtttggccgcggatatcgcgctttccgcgctgctgccgagcaaaaagatgtcaggcgcatactcagtatgcggcgtcggccgcaatgacgcgtagcggtgcgagtccggaaaatcatttcgaatgaaatgagtcagctcctcaagcttttcttcaaacaaacgggcgggctggataagctcccgctgcagcgcatcggttgacagctgaaatccgccgggcgctttgccgacaccgagcgccacacggccgggagcaagggcggacagaacccggaactgctccgccactttataaggactgtaatgctgcagcatcaccccgcctgatgcgagacggatttttttcgtgcttgcggcaagataccccagaacaatttccggcgctgatcccgctatctcttcattgttatgatgctccgccgcccagaaacggtcatatccgtattgttcggcctcctgagccaatttcaccgtttgccgcaaggcttcttctgcggtttggttttccgcggtgacactttgatctaaaatgcttaaacgaatcatacgacaggctcctttatgcgctcttttatgtcataaccgtaatcaggcagcacgcggcggaggaacttcttcgttctttcttttttcgtcttgtgaaaaacttcctcaggcgttccttgttccacgattgctccttcatccataaacacaattcggtcggacactcttctggcgaattccatctcatgtgtgacaatgatcatggtagcgccggtccgcacaatgttaagcatcacctcaagcacctcgccgacaagctccggatcgagggcggcggtcggttcatcaaacagcatcacatcaggatgaatggcaagcgcccgggcaatcccgacccgttgcttttgtcctcccgacagttgattcggataggcgtgtagtttatcctgaagccccaccttggccagttcccgctcggcaatggcgtacgcgtctgtttttttcattttccttgcgaccgtcaggccttccatgacattttgaatcgccgttttatgcgaaaacaaatgatattgctgaaaaaccatcgctgtctgtttcctcagtctgagaatgtcttttttggcaggctttttgcagttaatgacttcaccgtgcagcgaaatggcgccctcatccggccgctcaagcaaattaaggcagcgcagaaaagtggttttcccggaaccgctcgggccgatgatggtcacgacttctcctttccggacacttaaattgatcccctttagcacgtgatgactgccaaaatatttctgaatgtttcggatttcgatcataatgcgcctccttgatatctggccgctcttttttccgccagactgtttacagcttcgagaatcagcgttaatccccaataaatcacggccgccccgataaatgcttccagaaacgcatagttatcggatgccgcaatcgtcgccgttcctgtaatttcaggcactgcaacaattgccgcgatggaagtggtatgcaaaaagccgatgcctatattggtgaagttcggcagcgatatcatgaacgcctgcggcagaattacgcgccgaatcaactggccccgcgtcagaccgattgaatatgccgcctccgcctgccccgtatcgacggccatgatcccggatcggagaatttccgtcatataagcgcctgccgttaatgacagtgccatgatgacaaacacggcgaccggaatctgattggctgaccagccgagatgaaacgcgcggctgaattgatcggcaatcagcggaacccctaaataaatcagcataatatggagaatcgccggggtgctgcggaaaaaagacacgtaaaacgctgagcaggccagcagccatttgatgcggaatatacgcaccgtgatattgccgagagctatgaaaaatccggcaataatcggaatgatcgtcatcgccaatgtaagcggaacggttttcaacatttgttttatcgcagtgccgataaacggaatgtccagctccactgttctccctccttttcagccgtgcgcactcatgtcaaaaaccgtcacaaggcgcgtctcatctttcttgattcgtttttcggcccatctgaagacacattcaaataaaagggcggccgcgtaatacagaacagacagcgagatatacacttcaagagaatgattgctcgatgtaatcaaggtctgtcctctgcccgacatatccatcaccccgatcgaaaaagcgagtgatgtatcttttaagaaaccgatcaccatattcccgatgttgggaaaggcctgcacgagcgcctgcggcagaatgatgcgccggaatgtctgccctctgttcagcccgatgctgaacgccgcctccgcctgcccgcggccgacgctgttcacacctcccctgatgatttcggccgctcttgccgcgctgctcagcgcatacgtggcgatggccgcatacaaagggtccattttagaggtatcaattccggcgagcgccgtgagcgccggaatgccgtaaaatacaatgaacagctgcaccatgataggcgttcctctgaaaaaagagatatacagcttcgcaaactgattcaaaacgggaatgcgatagatgcggggcagcgccaaaagcagccccaatagaaagccgaacagcaaagacaccgccaatatatacagcgtgacgggcaaatacccgagcaatgtcggcacaaaggacgcgatcatactgatatcaaacgctttttccattgccggtccctctctttttcacttaatattgctcccttgaataatccgcgccgagccacttttcactcagctttttaagcgtgccgtcatcaatgatttccttgagcgctttatcaatgtcatcgctcagcgtttgttcatttttgttaaacataaagaacactttggcatttgacagcaccccgccgaccgttttttctttgatcgcgctcgttttgttttgaaaatcgacagcaaacggcgttgaaatcgttgcatcggcgcggccggatttcagctgattggccgcatcgtttgaaccttggccggcataggcgatttcaaaaggactgccgtgtttttcattccattttttcaggacaagcgcgccgtttgacgtcggacttgtaatgacccgctttcctttcaagttattaatgccgtgaatgtccccattatcttggagcaccgtgattttcagcgggaagttgttatacgcgacttgattgaacagaaattttttctcccgttcggcgcttttctccatttgatgagccacgatatcgactttatgctggccgaggctgacaagcaggttggagaaatccatcgttttaaaggtaaatcgatagtccggcaggcgcctgtcaagctctttcaccagctcaacgtcgtagcccgtcaatttgcctttatcatcaataaagcaaatattcgaaaattgagtccccgtgccgaccgtaatgttcttcacgtttttctgattgcctgatgccgcctcccctcccgcgccgcaggctgataacgccgccgttgccgcaattgttaatgacatgaccgccaatcttattttcatgtgatcgccccgttttctgcttcaattatttcgtgaaacttgattttgaataatccgcgccgagccatttttcactcagccttttcaatgtgccgtccctcacaagcctttgaatcgcccgatccgtatcgtccgccagggtttggctgtttttattgaacataaaatacacctcggtatcgagcagcacatcaccgaccgtcttttgtttgaacgcgtgcgtcttattttgaaaatcgacggcaaacggcgtggatacggtggcgtcagcgcgtcctgtctcaatttggttcgctgtatcattgccgccctgcccggcgtatttcaaatgtatcgggctgccgtgggttttgttgtatgccgtcatataatccgccgcgtttgacgtcgcgccgacgatgacggttttcccttttaaatcccggagcgtgcgtaccgcgtcattatccgccttcaccgtgatgtacatcggcgagtagttatacgggattttgtgatacaaaaagcgtttctcccgttccttgtttttcgccatattgtgcgcgatcacgtcaattttccggtttccgagacttgtaagcagattcgaaaaatccatcgtcttaaagacaaatttgtattgcggcagctgttcatcaatggctttcatcacttcaatgtcatagccggtcagctcgcctttttcatccataaaagcaatgttcggaaaatcagttcccgtgccgacgatgacggtctgcacgccgctccccgcttttgcgctttctccttgcccgcacccggccagcacgccgagcagcagaagcagacagccggctctgatccgttttttgatcattgcgcccagctcggtgtgcctaacagcgacgcgtcaaaccgctccggtatgagcacctttctcatcataactccgatgtctccgtctttctcctgctcaaaatacacttcatatcccctccgtctgtacatatctacaagccagggatgcttgcgcgccgaagtgccgagcgtgatggccggggccttcagcgtatcccgcagcacatgttcctccacataagtcaaaagtttgctgccgatgccctgccccttcagctcaggaagcgtcgcaaaccaccagacaaacggatattttgacggaggcgtgtcactctcccacggaaaacggatcgtaatggttgaaagaagccgtccatcccgttcgagcacgacggctgaatgattttcaatattttccgttaccatatcgatgtcggcccgcgccgacggccagtcaatctccaaattgcggatcggctgaaacgcgctgtacagcagctctaaaaactccggcgcatcctttttctcagccaatcgaaatatgtcttcactcattccggtcactctccccgcaaaaaatatataattccaatttgtttactaagctttgattgtttatactataaagcaaactgatttgtttgactaatcaaaaaaagtaaaggaaaggttcaagaaaattaatgaacagccgggaggggatttcgttggaactacgaaccattaaaacgtttcataccatcgtacagtcaggcagcttttataaggctgcagaaattctgaactactcacagccgacgatttcaatgcggattaaacagctggaacaggatgtaggcgcgcagctgtttgaacgtggaaagaagctgaagctgacaagggcggggcggctgtttcatgagcgggccgggcagcttctcgcgcaatacgaggtgcttgaccatactctggccgatatcagacagggccaggccggccttattcagatcggcatatccgaaccgacggcaagcctgatcttccctgccgtgctgcggggtttcttaaatgattatccggacatgtcggtcaatgtcagcgtggatgatgccaatacatgcagccgcaaactgctggagggcgctattgattttgcggtatgcggcgagccggagctgattctggaaaattatttcgatccgtttttccatgactcgctcaatgtcatcgtgtcagacagacatccccttgccgccaaagcaagcgttaatctcgaagatttagaaaatgaatgcctgatttttacgcccgccaattgcccgatccggattcaaattgaacagcacctgcagcgggccatcgggagccgctatcgaaaaatggagctgaccagcagcatggctcatcaatactatgtcagggaaaatatcggcgtctcaatctttacggcgacggcgcattcagagccgatcgagggcacgaaggtcattccgatccataacttaacaatttcaccgcctgtcgggcttttgacaaaccaaaaagaagagcactttgactgtgcaacaaaagatttaatcagcaggatcatcagccggtttcagcgtgatccgcattaaaaaaacccccgccactttgcgggggttttttatgttcatcttatataatgctccgcaccaagccgccgtcgatccgcaatgcagatccgttaatggcagacgacagcgggctgcttaaaaaggcgacaaagtgggcgatctcttccggacggatcaaccgctgaatgatggacgtcggacgattttccttcataaatcgtctctccgcttcagccgctgtcaagttttcaccgggataaagcgactcaagcattgtttcgacgccctctgttttcgtggagccgggcatgaccgtattcaccgtcacattcgtcccttccgtgagctcggccaggctgcgtgacagcgacagctgcgttgttttcgtagcgctgtaatgagccatttcctgagaaggcatgacggccgcttcactcgcgataaagatcacccgtccttccttccgctcaatcatccgctttgcataccggcgtgtcagccgcacgccgctcatgatattcacctcgaaaaaccggagccactcttcgtcaggaatatcaaagtattccgcaggttcaaagattcctaaattgttgacgagaatatccacatcaggatactgctgaaaaatcgcgccgcatccttccgccgtgcctaaatcaaacgcggccggatagagacgggcatccggcgtctgtttctctagttcccggatcgtttcgttcaccttttcttcacggcggccgttaatgatcacggccgcaccttctgcaatcagcgaagccgcaatcgccttcccgatgcctgacgtagatcccgtcacaagcgccgtcttccctttcaactgcaagtccatcatccattcctccctatcgcaagtctcttcttatatatggacagaaatcgaaagcctgaaaccttccgtccctattatcggatagaaaaatggatgaggggaagtacgcactttttagtgcctgtccgttgtcccggctgacggctgatcaatttgaatgaaaaattcaccatctaattctgcctgagcctcttgaaacagctccaagacatcatcagcatccgaacccaattccttctgactgatctcaaaattcttccacaccaaagtcagcggaagttcgatccagcctgtcagacaatcccataaggcgttcagattttcaccataaaagtccgggaaatctaattgatcttttaagattcggtgtaaagcttctgtgcttgtaacatcttttccgtctatgatgacgatttccatttacattcactcctttttgtcggcataaaaaaaccgcagtgcgtcatgtgacggcactgcggttcctctgttatgtatggagacggtgggagtcgaacccacgtccagaaacatcgattacttaagcgtctacgagcgtagcctgcatatttcgtgtttcactcgtcttcatgcctgcgggcgggccttccgagagctagtctgtcagtctcttcttacgttctcagacgggaacgcaagcgtagcctacttggatgtgctcttcacggacacataggcaatgtcaggaagagctcgctgcgtttattaggcagctagtgctaagttttggttaaaacttttagttttgccagttatatttaggtgcgtgttaacgagatcgcctctcggctcgcagctcaagctcgatccatccctgtcgaatccgtaacgtccccttgttaagggtatacgggagatctatcaagctcttgctcaactggctgtactgttattataccatgatcacaggcaaattcaattgggaatatcttcaataaacagcctgtgaatctgatgtgtgaacagtatagcacagggcatatcatcacatcaaggctcaggcatcagaagcctttttgtctgtctctgaacgctctttcgatttctcttttggcgtcttttcgttttaaatcttcacgtttatcgtatgttttcttcccttttccgaggccgattaatactttggcgaagccgtttttcaagtacagcttcagcggcacgagggaatagcctttctctttcgtcaggccgatcagcttattgatttctttccggtgcatcaaaagctttctcgtccggagcgggtcgtggttatagcggtttccctgctcgtacgggctgatgtgcatgttgtggaggaacacttcgccgcgctcgattttcgcaaaggaatccttcatgtttacgcggccggcgcggatggacttaatctccgttccctgcagcacgatgcctgtttcataggtttcttctataaagtaatcatggtttgcttttttgttttgcgataatactttgcctgatccttttggcatgccttatcctcctctctccgcaaaaaccgttcatgtgtgcgatacgctttattttagcaaatggagcgttccgcgacaatgaaaatgcggcttgcgaaagaaagcaaacagagcattatgccctatttgcttttcgcatttacttcttctttttgcgtttttgtttcggcgcgttttggaagccgcgttttttctttttcttcttcggttttgtaaaccattcccctttttcctccgatttcggcggtgaagccggggtattgctgtttaacacgcgtttccgcgccggtctgcctcgttttctgcggtcgcctgttgtttctctcggacggcgggtgcctttcatgccgacaatttcaaagtcgatgtttctctcatctttattgacgtcgacgactttgaccgtgatttcgtctccgatgcggtaaacgttgcccgtgcgttcaccgatcatggcgaaatgctgctcgtcaaaacggtaataatcatccgtcataaagctgacgtgcacaagcccttcaatcgtattcggcagctcgacgaacattccgaaattcgtgacggaactgatcatgccgtcaaattcctcgccgattttatcaagcatatattccgcttttttcagatcgtccgtttcccgctcggcatcaacggcgcgccgttccatcgttgacgtatggtcagcgatttccggaaggcgttcggcccacttttcctgagttgcttcgtccgattgtccgttgatcaaatacgttctgatcagcctgtgaacgattaagtcaggatatcggcggatcggcgatgtgaagtgcgtataaaattcagtcgccagcccgaaatggcccaggctttgcgggtcgtatttcgcctgcttcatggaacggagcatgaccgttgaaatcaccgtttcttccggacggtcccgcacttcatcaagaatgctttgcagcgcgcgcggatgaatgtctccggctttccccttgacgatataaccgaatgtcgtgacgaactccaagaacttttgcagtttttcggcgttcggctcttcgtgaatccggtaaataaacggcacgttcatccaatggaagtgctcggccaccgtttcgtttgcgacaagcatgaattcttcgatcagcttttccgctactgagcgctctctgatgacgacgtcttttacggcgccttcctcatcgacgagcaccttcgcctctttgaaatcaaaatccacggcgccgcggtccatccgtttcgcccggagaatttccgccagacgttccatgtctttaaacatcgggacgagcggctcatatctttctttcagctcggcgtcgtcttctgtaaggatccggttgacatctgaataggtcattctttccgtcgttttgatgacgctttggaagatctcgtgctccgtcacctgtccctgctggttgattgtcatttcgcaggaaagcgtcagccggtcgaccttcggatttaaagaacagattccgttagacagtctgtgcgggatcatcggaatgacccggtcaaccaagtacacgcttgtccctctttccagcgcttctttgtcaatcggggaattctccgtaacgtaatggctgacgtcggcaatatgaacgccgagcttgtagctgccgttatcaagctttgtcacggtgacggcgtcatccagatccttcgcatcggcgccgtcaatggtgacaatgacctgatcgcggagatcacggcggtctttgatgtctttttcatcgatggtatcgggcgtgcttgttgcctgctccatcgcttcagccggaaaatctcccggcaggccgtgcttatggatgatggataaaatatcgatgcccggatcatttttatggccgagtatttcaacgatttccccttcggcgttcattctgccttcaggatagcttgtcagtttgacgacgactttatggccttccgcagcgccgttattggcatgtttcggaataaaaatatcactcgtgattttcttatcatccgggatgacaaagccgaagcttttcgtttctgtgtatgtgcccacgacgcggtcgatgcttctttccaggatgcggatgaccgtgccttcctgtctcgatccgcttgactgggaattgagccgcaccatgacaatatcgccgttcatggccgtattcagctcgttcggcggaataaacacgtcgcttaaagaggtatcctccggcagcagaaacgcgaagcccttcgcatgcgcggaaatttttccttttactaaattcattttttccggaagcccgtagcggttgcttctggtgcggacgatctgtcccgtctcctcgagcgccaccagcgcttttaccagctctttaaattcatcggcttccgtgatgttcagcatctcctcgagttcctgaatggtaagggcttgtacgcctcttccttcataaacgcgagaagacggtccataaacgcttctttttccattattcgacctcctgtttgttaccaatcgagtttctctaaaaattcgtacacatcctgatgaacgaggtcccgttctttatcgagtgtaatgacatggcctgattcttcataccatttcagctgtttgtcgtccgtttccacctcgttgaaaatgatgttcgcactttctgtattaatcatatggtcatgccgtgcctgaaccacaaatgtcggggaatagatcatgtcgacgtttttgcgcacatcggcaatcagctcctggagcgatttgagcgtattcatcggcgttttttcaaactccttcatttccttttcaatctgctccggctgttttccttcgaattttttataattgcgcgcgtaggagagaactccttcgtacataacctcttcacttttaatgtgcatcggcgcacacataggaacaattccctttatgggtacagtgtaacccaatttcaatgaaaaaaccccgccaagcgacagtccgcacgccgcaatgttttcatagccttcagaccgtaaatactcataaccgtccatgacgtctttccaccaatcttcaggtcccgtatgtaccagctcttccggcggaacgccgtgccctttatattgaggcgcgtgacaagtgtagccgcgctcattcaagtagcggccgagcattctgacgtctgccgtatttcccgtaaatccgtgcagcagaagcaccgctttgtctccgcctttaaatgtaaatggttttggtgtcacaattttcatgctcataaccccttttttgcacattcaatttagttttccacagttttgcgagaaacaaacgccgtctctcaacaagaaaaaggcctgatattaaatcagaccttatacaaacattgccttatacgatatacgctagcgaaatcgtcaacacgaaaaacaagactgccagcacaacggttgtgcggtgaagaatcagatcaaggccccttgctttctgttttccgaaaagctgctccgccccgcctgaaattgcacccgataaaccggcgcttttgctggtttgaagcaatacgacaataataagtgcaatactgacgataaccaataaggtaatcaataatgtgtgcatcccatacacctccagactgactggcctacattgcttctattttacatgaaaaacaaaggcatgtcacgccgtatcggtgtacatcatgtcagaaaaacggaaatgcgtttgaatcttccatcttcattgacttttgtcaacaaagtcgtagtaaaaaagatcttcaaatttcatgtcaaagtaatagagcatttttccgatgaccagctggcccggccttcgctctccattcagtacacggctcagtgtggcgggagatattccgatctccagggcgagctggtttaacgagtagtcattattgaccatatactgcagcacataatctcttctgatctgtatcttttcgaccactttcttcaccttccgttctgtcaaatactttctttcttatacataagatacggcttttgttaacttttgtcaatacttttccagcctggctattccctttagtcaataaacatactagaatataaatagaccgcgggagggggagagactgtggaaagcttcgggaaacaattgcggacattacgggaaaaaaggcatctgacagtgaatcagctggcaacgtattcaggcgtcagcgccgcgggaatctcgcggattgaaaacggcaaacgcggagtgccgaaacctgcaaccattaaaaagctcgcagatgcgttaaaaatcccgtatgaggaactgatgcagacggcgggatacatagagaccgtccaggaaacgagagccccgtacgacacgggctgcaccttgctggaaaaagccgaaacgtatgagctgcatgatttatcccttttggagcgggagaactggcggcacctgtcgaaagaagacttggttctgcttgataaatactttgcgttcttatcggcggaagccaaaaaaagaacaaatgaagactcatgactttgcacatgtgaggcgatcttattgaacacattcggaaagcaattaagagagctgcgccgcgcccggaagcttaccgtcaatcagcttgccgtctattccggcgtcagctcggcgaccatttccagaattgaaaacgggcaccgcggcattcctaaacccgcgaccatcagaaaattggcggacacattaaaaatcccgtacgaggagttaatggcgcgggccggacacatcaaggcatttcaggaggaaatccgtgaaacctccgaaagctatcaatccatctgcgccatctatcagaccgccgttgacagaggcgcggagcatctgccgctgtttgacagcaaaaagtggcagcacttcacaaaagaagatattgaaagcgtcagcaaatactttgattttattgcggctgaagcgaaaaaacgctccccggattcctcatcctctttttgatcctctcctcaacttaacaagcgccagacgtacgttccctccgattttgcggtataatagcagaagacgaggtgaaaaagcatgaaccaatcagaaatgtgccccagattcgaaaaagcggtcgacatcctaagtaaacgctgggtggctctaatcgtctttcagttattgaacggacagcagcgatttagcgaaattgaagcggcgcttccgaatttaagcggaagagtcttgtcagaacgtctgaaagaacttgaaacagaaggtgtcatcaaacgggatgttatccccgaaacgcctgtccgcattgagtattctttaacggaaaaaggctgcgcattagcccctattttagaggaaatttccaagtggtcttcaacatggattgatccttcctgataaactcttttccgcataagcggctgatctctcaaacggacagccgtttttatttttgcttttcttatacagaaaaacaagccctcaggcgtgcagggcttgtttttgtctgacgccttccagcggaattcgaatctccgcccgggctcctccagactcctgattttcaagtattaattcgccgtgatgaagatgtacgacgtgatgggcgaatgtaagccccatgccgtgatgccccgccgaatgtctgcttttatcctccgtgtaaaaaagctgtgtcgctcttttcagcgcctccggcgagaacccgcttccgctgtcggatacggcaagatggagggcggaatcggtgcacaggacgtccacacggatttcccctccttccggcgtatagtcgacggcatttgccgcgatattcatgaccgccctgtggagcagctcatgatcgatcggcgcttctattcggtcaattccccgttcgctgaggacgagatccatctgcttcggccccgcaagcgccgccgcgtcacgatatatgttttgaatccactctttgaggtcggtatattcgacatgaacggcaactgcctcctctgctttggaaagctggatcagctgtccgacataatgctcgattttgtttccggcatccaggatatactgcgcatattccgcctgctcctcatcaggttctgttaactggagcagctcggcatttcctttaatgatcgttgccggaattttaatatcatgcgcaagcgcgccgatctgttctttctttatccgctccgcctcccactgcgccgccagagatgcctgaagcgcgtctttcattttcagcagagagtcaatgacatcgtcaaattcttttatacgcgacctttttggattgatatttaaattctgtttttgaatgcttgccgtaatggagctgagtgtgctgaaatgccgtctcagctgattggcgaaacgcgtcgtcacgataaaaacagtcaaaagaagcaaagtgatcagaatcgtaagacccgtccattcataattcggcagatagcgccttaacagcggcgactgaaattccgacctgagtgaatattggagaacgccgtattcatctttccgatttatcaccatgaatcctttttgagcataattaaaatacggcgtatgctgaatcttttttctggcgttggccgcatcttgttccgtcatcgttccttttgtcatccgctttgtttttttatcaaaaacggcgtatgtcatacctgcggggatcatgtcttctgttatcttttccgctgatttcaggcggggtttgatctgttccgcctcatgctcgctgtagtttgcgggcaggatcgctccggcattcatggcaatggcatttaaggcgacgcataatgccgccacccccatcgtgctcagacacaaagtgatggtaaatttgacaagctctttgcggatgctggattttccttttgctattcccatttgtatccgacaccccacaccgttttgatcggatcagccccgtgttctttacattttttccggatggttctgataaactccgtaatggttgaatagagcgcatcgccgtccaagccgtacacttcctcgtaaatctgctcccgtgagaatgttctgtttttatgctgtgccagaaattcaacgattttatattcgtttttcgtaagaggcagtttccggtcatccatccatacttctttattgtcaaaatcaaacatgaagcctgatatcagccgtttcgtctgatgcttttcccgccgttcccttctgacatgcgcgtttacccttgccatcaattcctgtacgccgaacggctttgtgatgtaatcatcagcgcctgtcatgaggcctttcacaatggattcttcgtcagactttgccgttaaaaacaggatcgggctgtccaccagcggccgaatccgccggcagagttcaatcccgtccgttccgggcatcatgacatcaagaagaatcaaatcatagccttgaaaaaaatccaatgactgatcttccgctttttccagaatcgttactgtatgctgatcacgctgtaaaatgtttctgatcagaacgagaatatctttttcatcatcaattgctaaaatgtttgccaccggccgaatcgctccttgcctttattcatatgaacgccgcccttcccatcttctgcaccaatagaggccggccagacataatatcactatagaaaaatataacattatttctccgaatctcatatcgtatcttacataagggaggaactcttttttgactttgtcaaaatgcagcagtcctgcaaggcctgaaagcctcacgctccatgcccacggaaaaaaacgccagatgatatcgccaagtcccgtattcatgagcgccgccattaataatcccgcaccccctaaaagcccggacggtcccatgccgtactttatgccgacaaaaaaagacatcatataaagcggaatactgccggcaatcagccacgcccctccttttaaaaagagaagatacgggagatcattgatgtgaagaacaaatttcaaccccgccaaataaagacagatggcgagaccaaccgataacacattcaataggagcagcagaagcagcttgcccgcaaaactgacgattttagaatacggaaccgccagcatcatctgaaaatggcccgcctgttcctcgacagaggcagacatgccgcagacaatactgatgatcagagggtataaaacggcaatcgcgctgaaaaagacgctgtacagcatataagactcctgaacccttccatacatatataacaggaaaaatcccgcgcataaaaccggcgccgcagcatgcatccatatgagcggcgtgcgcttcatttttaatacatcggcccacatatatcgtaaaagcacggtcatgaccggtttcctccttttgaaaatgacactgcggaaacaaaacttattgcgataaaagaaagaatagaaagaataatagccggaatgatcacgtttccgtttaataagccgctgtttgcgggaagcggaattccgttcgggtggattccgagaatcggtgacatcagccggactgaccagctccacggactcagccaccacaatgaaccggacgccggcacaatgcctaaaacaaaggcggcgatcatattgatgagaatgactgccgtaaatccgaactgtctggcaatccataagcacaatgggatttcccaaagcgtcgtcagccacaaaagggagcttgcttcaacgcctttcagctgcagcgcagcaattgccggaaacacaaggccaagcaaaaacacgatgactaaaaagacgatttgcgacaggagtgaatacagcgcgatcaaacttatttttgagaaccatatgctttttaaatctgccggcaatgagtacaccgcgcggtcattcgctgattttttctcttttttaacagataaaccgcacattagagcaatcatgagcggcatgaaaataaccgcccaccaattgaacgtgcccgtcataaaataggccgcattcagcagaaaagaaaaagccgcgttcagaagcggaatcagaatgatcagctttctgataaatgttcttttagatgtaaggtgttccgcctgcatgtactgaatcattttcctgtccccgctttctcccgtgttgatttgacaacctccagaaacagccgctccagatcgtcttcccggctgatttctccctgatatcctaaaacgccgtcactgatgattccgatatggtctgcgatctgctccacttctgataacaggtggcttgataaaatcaccgtcattccctgtccgggcagggagcggataaattcccgcaaatcctgaatccccatcgggtccaatccgtttgtcggctcgtcaagaattaagagcgacggacggtttaataatgccaacgcgatgccgagacgctgtttcattcccatggaaaattgtccggcgcgcttttttccggttcccgttaatcccgtaatttccagcacctccgcaattcttgaatcaggcagtccgagcatcacgcagcggactttcagattttcagcggctgtcaggttgctgtaaagcggcggtgcttcaatcagggaaccgatgcttttcaaatcttcgcgcttccatgtatgtccctcgaacagaacctcgccggatgtttgctgcagcatgccggtcaatattttgagagtcgtcgattttcccgcgccgttcggaccgagcaggccgtatatactgttgcgcttaaccgatagagacacatcagccactgcctgttgtctgccgaatgatttttgcagctgtctcgtttctatgatgttgctcatatgattacccctctgctttgttatttgatatgtaagactttacagcgcagttatcaaaatttaatcaagaaatcaaaaaaagcatccttcacgcggaagaatgctttttttcatgaggctgagcgtacgatcagctttcttttttgttttttcacagggctgagggctcgttccagccacgccatcagcaggtctgcggccaccgccatcagcgcggtcggaatggcgcccgccagaataatggcggttccgtttgtcgcgttcgagcctctgacgatcatatccccgagaccgcctgcgccgacgaaagtgccgatcgctgtgatgccgatggcaatgacgagcgccgttcggagacccgccataatgacggaaagcgcaagcggcagctccaccatacgaaggatttggtatttcgtcatgcccatcgcttttcccgactcgagataagcgtgctcgatattgataatgcccgtgtgcgtatttctgagaatcggcagcagtgaatacaaaaacaaagccgtgatgaccgtattggcgccgagccccatgacaagcatcaggacggcgagcatcgcaagcgccggaacggtttgaatcacgttcgccacagcaaacacccagccggcgagacgcccgtgcctggctgtcacaattccggccggaatggcgaaaacggcggcgaaaacgacgccgtacgccgacatgagaaagtgccgccagcactcatacagaacatagctgccgttttgagcgtaatacgtaaacaactctttcatcgtgtccatccgcacatctcctttccgttattcaaagtaatgatgtttttctaaatattccttggccacgacggacggctcttttaatcggccgtcaacttcgtaattcattttctgcatcatctttgtatcaatcgcgccgatcattttattgatcacgccctccagttcgggatgctcttttaatacatgatccggaacgacgggtgaacagtcatacggaggaaagaaccgcttatcatccttcagcgttttcagtccgtaagcgatgattcttccgtcggtggaataagcgagcgcgatatccatctttctgcttttcagcgcgtcgtatacgaggccgatctgcattggatacgtgccttcaaatgacattccgtatgttttcataaaatcctgatatccgttgcctctcagcttcatccaatagttatctacgccgaatttcagatgggatgcttcttttttgacatcggataccgtttctaaatggtacttgctggcaagctgtccggaaacggtaaagacgtatgtattatcaaagccgtaagaatcaaaccatttcatgtcatatctgttttgaaattcacgctgaacgagccgcagcgctttgtccgggtctttttccggctccatgcgaagcgtcccggtcagcgcgtctcctgtatagcgcgtcgcggcgatatcaatatcaccgttgatcaaggattgctgctgtacggcgttggagccgagatttttaataacggatgttttcaacccgctgtgatgttcgatcatctgtccgagcatgcttgcgatgatttccgattcggtcatgctttgcgcgccgattttaatggtgtcctccgatgcggcgctcaatcccgggagcgagcatccgccaaggagcagcatgccgagacaggcgattgcgagcagccgttttttgcatctattccccatgtgagacctcctccttataaagcgtcctttatgcttttcagcccgtcaggcgtgactttccgttctgtcacccccagcatgtaatcgacggcggccgccagcatcgtgaccggaacggcgcctgcgataatatactccggctgataaaggttcaagccgataaaaatgtaatctcccagcccgcctccgccgataaaggaggcgagcgtcgcccagccgattaaataaatcgaagacgtcctgatgcccgccatgatgaccggggcggcaagcgggagctctacaagcctgatctgctcccatgccgtcatgccgattccttttcccgattccagaaggtgccgattgacgccgagaatccccgtatacgtgtttctgagaatcggcagcatggaatagaaaaacagcgccgcaacggccgggacctttcctacgcctaaaagcggaataaaaaacgcaagaatggcaaggctcggcaaggtttgaatgatgttgacgatgccgatgacggcgccggctcctcttttcatcctcgtcagcaggacgccgagcggaacggcggcgagaatgcccgccatgacggcgattaatgagatgtacagatgctcccatgttttataaagcatctctcctccatttgcctgtaaaaattgtacggtctgattcatatcaattgaagcctcctcatgacatcaccgcgagctgattctcttctccccagatggagtcatagacgatgtcaacgaggcttgcccttgtcacgattcccgttagccggccgtcctcatcaaggaccggcacaaatttcacgcctctttttaaaattttatggacggcgtcgcgaagcagagtgccgcttctgaccgtgtacagatcccgttcaagcacttccgcgacggttaccgcttgtcttcgtttgcggtcaatcatctccacatcgacataaccttggagaacgttcttttcatcaatgacgagcagcgaatccacccgctcggcacgcatcagctgaatggcggctgacagtgttttctcaggtgttaccgtcacgggatcgggattcatgatctgctccacccgttcaatatcagggctggatgattgaatcagccgttccttgccgataaactcctcaacaaattcattcgccggaaatctgagaatctcatcaggcgttccggcctggacgatttctcccgctttcagaatgacgattctgtctgcaagcttgatggcttcgtccatatcatgggtaacaaatacgatggttttatgtaaggttttttgcagttttttaaattcttcctgaagggaatctctcgtaatcgggtcaagcgccccgaacggttcatccattaagataagcggcggctctgcggcaagtgcccgtaatacacctattcgctgctgctgtcctccgctcagttcatgagggtaacggtctaaatattcaggccccatatcaacgagctttaaaagctcccgcgcccgttccttccgtttttcggcagaatgctttaaaagcttcggaacgagcgtaatgttctgctgaatggtcatatgcggaaacagcccgatctgctggatgacatagccgatgcttcttctgagttccaccgggtcttgttccataatgtttcggccctctatcaggattctgccttctgtcggttcaattaagcggttgatcattttcatcgtcgtcgttttgccgcagccgctcggtccgataaaacaaataaattcgcctttgtcgatattcaggttgatgctgttgacggcttttttcccgcctttatacgttttcgagacattttctaatgtcagcaaacactcacacctccgatattaaatttgttcaaatcgttaaattcaaatttaacttttcagacaattgaacgtttcccattataaattaaactttgtaaattaaaaagtttacaatttgtccatattatatataaaggttgtgtaagcactgatttacccgtattgaccggcaaagttcttcttattgctccgaattactgccaaattctctcggaagagcatttccgccggtttaaaaatgtggtatattgacatcggaattgctgactgaaaggattgaaactgttggagaaagatccgttacacgtaatcgaacaagctgaagatcatttgatagaacgaatcgctgaaaatatgcatacattcggaatgcccgcgacggtggggcgcattttaggcattatttatatgaaccgcaagccgatgaccttaactgaattatcagaagcgaccggcatgagcaaaacgagaatgagccaggcggtccgtgaaatgcttgacgtcaatctggcggaaaaagtgtttgaaaaaggcgtccgcaaagatttatacgacgtcgagcaggattactaccaaacctttattacgctgtttacggccacatggagcaaggtcgtcagcaaaaataaaatgatgcataaaaaactgaaccgcgaactgacggccgtccttgaaaacggcgtgccggaagaagctgaggaaaaaatcaacgaactgctgaaagaattaaaggattggcttgattactacaactggatcagccgtctgatcgagttttttgaaagcgaagaaatattcaagcatgttccgaagccataagaaaaaaaacgccctgacccgcaaggcgtttttttcatgccgcattcggcgctttggttcgttttttctttctcaccggactcagcgcccgctccagccatgccatcacaagatctgcgataacggccatcagcgctgtcggaatggcgccggctaaaataatcgctgttccgttcgtggcgtttgagcccctgacaatgatgtcaccgagtccgcccgcgccgacaaacgttccgattgccgtaatgccgatcgcgatgacaagggccgtccgcagccccgccatgatgacggaaagcgcaagcggcagttccaccatgcggagcacctgaaatttggtcatgcccatcgcttttcccgattcaagataagcgtgttcaatgctggcgattcctgtgtacgtattccggatgatcggaagaagcgaatataaaaacagcgacaaaatcaccgtattggcgccgagccccatgacgagcatcagcaccgcaagcatcgcaagcgccggcacggtctgaatcacgtttgtcaccgcgaatacccagccgcttaatgttctgtacctggcaatgaagatgccgagcgggacacctacgatcgccgcaaataaaacgccgtataccgacatgagaaaatggcggtaaaactcctgaagcacataggccccgttttgagaataataagtgccgagctgctgcagcacttccatttgccccacctcatttcttattcaaaataatgatgtttctccaaaaattctttagcgacgacggacggttctttcagcttgccgtccacctcgtaattcaattcctgcatcgtttccgtatcgattttgccgatcagtttattcacaatgcccttcagttcaggatgctgcttcagcacgctgtcgggaatgaccggcgaacagtcatacggcgggaaaaactgcttgtcgtcttttaaaattttcagatcgtacgctttaatccgtccgtccgttgaataagcgaggacggcgtccattttcccgtttttcacggcatcgtatacaagtccgatctgcatcggataggttgtgccgaattcaaaaccgtacgtgtcggtgaagcccttatagccgtcgccttttcttttcagccacgcattgtctacaccgagcttaaattgatccgcatgcttcttaatatcggatactttgtctaaatgatctttttccgcaagctctttcgtgacggtaaaagcgtatgtgttctcaaatccgtaagaatcaaaccatttgtaatggaagcgtttctcaaattccttctggacgatagataatgcttttttcgggtctttttccgcttccatgccgagggtgctcgttaaatccgttcccgagtagcgcgtcgcggcgatatcgatttcaccgccgagcatcgcctgctgctggacatagttcgatccgaggtttttaattaatgccgtattcaagtctgtattgtgctcaatcatctgtgcgagcatattggcgataatttctgattccgtcatgctttgcgccccgattttaatcgtatcatcggaagccccgctcaggccgggaagggaacagccgcccagaagcagagcagctgacagcgccagtgcgcacatccatctcttttggtttcttttcaaaacagccaactccttatgatacttccttcagtcctttcagccctttcggcgtcaccttccgttccgtcgccgccagcagataatcaatgataatggctaaaatggtgacgggcacggcgccgccgataatatattcaggctgatagagattcaggccgataaaaatatagtctccgagcccgccgcccccgataaaggaagcaagcgtcgcccagccgatcagataaatggtggatgtgcggatgcccgccataatcaccggaaccgcaagcggcagttccacaagcctgatctgctcccagaccgtcatcccgatgccttttcccgattccagcagatttttgtttacgccttgaatgccggtatacgtgtttcggagaatcggcagcaccgaatagaaaaacagcgcgacgatcgcgggcacctttcccacgcctaacagcgggataaaaaacgccagtatcgcgagactcggcaaggtctgcacaatgttgacggcgccgatgacggcgcctgcgccctttttcattctcgtcagcgccactccgagcggaacggcgacgacaatgcctaatatgacggcgatgatcgaaatgtataaatgctcccacgttttatataacagttctccgccgttcgtctgcaaaaacttgatcatttcattcattgtaagcgttcctccccttgtcagcctgtcaccagctggtcttcctcgccccagattgaatcgtaaacgatgtcgacaaggctcgcccgcgtgacaattccgactaaatgcctttgttcatcaacgacgggtacatatttcattccgcgctttaaaattttgcgtacggtatcacgcagcagtgtaccctgctcgaccgtatacagatcagagcggagcacgtcgccgacgaggctcgcttttttccggttctgatcaatgatctcgacatcgacatacccttgcagcacattcaggtcatcaacgacaagcagggaatcgacacggtgctcccgcatcacttggatcgcctgcgaaagtgttttgtccgccgtaacggtgacaggctttttgttcatcatctgctcgacgcgctcaatgtccggtcttgattgcaataaccgttctttgccgataaattcttcgacaaactcattagccggattccggagaatgtcatcaggagtgccggcctgaacgatctctcccgcttttaaaatgacgatccggtcagccagcttaatcgcttcatccatatcgtgggttacaaacacaatcgttttattcaatgttctttgcagttttttgaattcttcctgaagggaatcccgtgtaatcgggtcaagcgctccgaacggttcatccataagaataagaggcggttccgccgcaagggcgcgcagcacgccgattctctgctgctgtcccccgctcagctcgtgaggatagcggtctaaatattccgggcccatatcgacgagcttcaaaagctcccgcgcccgttccttccgcttttgttccggccatttcagcagtttcggcacgagagaaatgttctgctgaatggtcatatgagggaaaagtccgatctgctgaatgacgtagccgattttccgtctcagctccaccgggtcctgctccataatgttttcgccatcgataaaaatctttccggatgacggctcaatcagtctgttaatcattttcatcgtcgtcgtttttccgcagccgctcggcccgataaaacaaataaactcgcctttttcgatatttaaatcaatgctgttgacagctttttttccgcctttatagactttcgatacattttctaatctcagcaatccgtgcacctccgaagggttccgttatttttctgaaaagtataatctttattataagatgaaatttgtaaaataaaaagtttacaatgtgttgaaattatatacaatatacgtattttttcatgttatcccgctgacaatgcggatgttcttacaatcgctcccgatagctcgcatatcctgccgcatcatctttttcatcaactgtaaaaaatatgatatattgtcagcatgaaaagccagtgaagggatgatcagccgtggaaaaaaacgctcttgatatcatcgggcatgctgaagagcatctcattgagagaatcgccgagaatatgcatacattcggaatgccggccacacttggtcgtgtgctcggtattatttatatgaaccgcaagccgatgacgttaaatgagctgtcagaggcaaccgggatgagcaaaacgaggatgagccaggtggtccgtgaaatgactgatgccaatctggcggaaaaagtgtttgaaaaaggcgttcgcaaagacctttacgacgtggagcgtgattattaccagacgtttatctccctgtttacggcaaattggacaaaggcggtcagcaaaaacaaaatgctctataaaaagctgaaccgcgagctgactgagcttctggaatcggaaaatctcagtcccgatattgaagaaaaagcccgtcagcttttggatgaactgacggattggctccattattatgactggctgagccgtttgatagaattttttgagagtgaagaagtgtttcagcatgtgccgaaaatagaaaaaagcagcccccgaagataaccgggcgctgcttttttaagtcaggaaaccaatatcgggaacatgcctttcagaccggcgccgatcatgccgatcgccaccaccgccaaaatcagccccatcagtcgggtaatgacgttcatttcggttttcccgagcttattgctgatgaaagaagaatagtgaaagaagatgaacgtcatcgcgatgacggccgcaatgccgataagcacgctgatgtaatggatgatgccgccatggccggccgacagactcatcaccgtcgcgatcgtaccgggtccggcgataatcggaatcgacaaaggcgtcacggatatatcggctttctccttgctctcccctttctcttcatgatggagagactgtacatgagatttcttcgcgttcagaagattataagcgatgccgaaaataaaaatgccgcccgcgatacgcaaggcatgaatgttaatgtcgaacagtttaaagatcagatggccgaaaattaaaaaagcagccaagatgataaacgacagcacggaagccttgcgtgcgatcgctgtccgttctttctccgggtatccttccgtcagtgaaagaaaaatcggcacgtttccgatgggattggagactgcaaacagtgaaatgaagacatgaatgatgaatgaaaacatgcgtacctccttatgacttgccgttattgagttatgttttgttctccgctgtttcttatgcatgatttttaccccggggtctgctttttataacctcagccggacgatccggaaaacagaaaaaaaccgtccttgtaaggacggtttttttctgtttgctatctccataagccttttccgaatttcaacagccgataaagcattttcaatttttttagcatgcgttaatttcctttttcactctgaatcaatgcgccgagagacatgatatctatcagctccaataaaattctaccataatgggtactttttctctattatcaattcatagagaaggtgatttatatatctttagaaaactccgttacatccgtcctattttcttttataatgtaaatattgaacaaaatccctatattacttgtaaaaggagttttagaatgtattgttctcaatgcggccatcatactgatggcggaaaattttgtgaaaaatgcggtgcgccccagcccgggcagggaggcgcaggccaaacacagggtcaggccgctcaggccggcgccgcggctaagcaggcttcaaagcaatttgccttattcgtgcttgatgtgttaaagagaccgtatcaaacatgtaaaacgacaggcggcgaacagcttgtcagcagcatcatcaacatggtgcttttctgcctggtgacgccgattatgttttatattctcttatcagacggctttcgtgacgtcagttttaccgcggttgtgatcaaaccggcgcttacctttgcattatgcgttttctgcctgtatctcttgatttttatcgctttgaaggccggcggcgcgcaggtgtcatttaaagattcgctgtccagattcggagcatttttgattccgtttacagctattttgcttcttgccctcatttttatgctgcttcatacaaccgtttgctttaccattctggctgtcggtcttttaggagcggcgtttgccgtgcctccgctcatgctggcgagctatcagcatcagctcactgctaaggcggatatcatttattctgttatcgtcatctatttgatcatttgcgtaacgtttcaattcacgatcaagcattatatgaaagaactcatgaattatttcttcttttaaaaacggaaacccccgccgcctgattggcgcgggggtttttttattgaatggatgttaaataaattcttccgtctttgacaacgccgccatacgtccaattgtatgttctgagcttcggactgccgccggctttcgtaatataaaactcctcgtacgtatgaatcgtcagatgagagcctttctgtgaaaagcttttgacattcactttattaaatacttcagtcgtcccctcgctgtacagttttttgaccagtttctgctgatcagcatacaaagggcttccctcttctaaattgcccgccatgatggcaaaattgttaaggctgacggcgcttgattgatttgtcaggtaatcagtcataaacgatgtgacttgctcgtttgtcacgctgcctgaagctgtatttcctttggaagatgcccatgcggatgtataggttttcggctggtcgttttttattttttttacatttgtcccagaagaatctgaggctggatcagctttttcaaaaacccattttttatgttttgtatcatatgagagtacataatgaaagctcggctcagcctcttccatatcaggcttcgtattcccgtcgaaataagcagactcatgaagctctttacccgtaacagttacttgccagcggccgttctcttgagaaatcgcaaatgaatccagatcaaagcttgtctctttatactgatctttcaaaaaggtgccggaactcttcatgccggataccacttctttcgtctgctctttccaggcggaaccagcctcggtcatctgatcggtatttccgtctgccatcgcttttgtatactgcttcgttgttttgacaatcgtgtccatgattgtttgttgtgtatcttgatccgggataagcgttaattccatatcagtaccgttgatcggaacatcggcagttttcatttttccccaaggaaaatcagcctccacggcggctgtcatggaaccgtcagttaagagcggaccgtatgtaacggatgtaaacggatctttatggacggacttgccgtttatcagcagatcgcctttcgcgcttttgaagctgtctgccggagtgaacgtcacatcctcggcgtctaacggcagatcaaaatcaacattccggctgccggccgcctctgcctcttgctttttgacaacgtcaaccgtgtcatttttaagcttggcttccgccgtgtagacaccgggtgcatacgggccgaagatttgggtttcatcggcttttttgaccgtccctgttttctcgctgttgatataaagatcggcgcctttataattgctggtgacgcggaaataaaccggatcgactttcagttcgtaatggtcaaacaaaagaagggttttaccctcttttttgacgtataccgcatctttttctgatgaattgccgcgaagcgtttccagcagttcatcgtgtttctttgcgtatgcaaggagcggtttgacattggtctcattcagcttcagttttttgtctgaaggagtgagcagggctgcgagctttttcgtgtccccgtcatgaaccgcctgttcgaattgatccgtgagccttttttcagatgtcagccaggctccggttttatatgcggcaatcaataagatcagcgctgcggctatgccgccccatatgaagagcgtttttttagggatcggctttctcatttgtgaagcaggttcagccgctcttacagccgcctgccgttcaagccggcttcctttcccgatcggttttccgcattctttacagaaatgcgcctcttcgttgttctgtcggccgcaatacttacaaaaaaacatgactttcctcctattcaatctacaaaacttgtataacttttcctatgtttcatattttataataaagtagaatgattttggagttattttgaaaaatagctgtcgatcataacggaggaggagaaacggacatgcaaaaactgagcatccgaaaagccgcggatccggatgaagcgctgtatgaactattgctgctggccgatccgtcgaaagagattgtcgatgattatcttgtaagaggagaatgctatacggcttggacgtcagacgagcttgcaggggtttacgttttattgcaaacaaggcctaaaacgatagaaatcgtaaacatcgcggtaaaagaatcgctgcagaacaggggattcggaaaacagctggtgcaagatgccattgaaaaagcgagacaatcgggagctgacacgattgaaatcggcaccggaaattccagtattcatcagctgtcactctatcaaaaatgcggattccgcattcaggctgtcgaccatgatttttttatcagacattatgatgaagacatttttgaaaacggcattcaatgcctggatatgatacggctttatttggatttatgataaaaagggcgccggctgataccggcgcaccttcgtttaccattcagacggattgatccgcttgtttctctgaatttctttgactcccttgtctgactgaaaaaacagcaaaaacgatcgtaagggtcagtccgaccgccgcaaaaatataatccgcattcatcaacagcagaagccctgtgtagacagcggcagacagcggttcacccattttgacaatggaaaaaatcagtgcaaaaacccttccgaaatatgcggccggaaccgtcttttggaaatacagcaccgtttgcacatcaatatacgagatgatgatgccaagcaccaggaaaatgatgcactcaaacccgtgaagcggaaaaaacagcaccaaaatgagcagtcccgctgccgttaacgtccgcggatacagccggttcaagcgttttgtattccatttgaaaaatacggccagattgcccaaaagcatccccgcctgaaacattgaatacatgacggcaaaccatacagaatagttctgctgaaaacgttccacagcaagaatcggccccattactgaaataagaccggcaatgacgagatttacgacgaaaaagtatccgaccgatgtcagccatgccgcatttcctttcagcattctgtagccggcttttacatcttcagccccgttgcttttttcattgggctgttctgaaatacgaatgaacgcgataaatgccgcggagataaaaaaagcagttccgtttatggcaaacagcagcccgaacggaatagccgcaatcatgattccgctgatcagttttccgacgatgagtccgatcaagtcactcgtattgatcagagatgtcgcctgatcaagatgctgtttgcggacgagcagcggaatgatcgcgactttcgccggcgcaaacagcatcgattgcagagatagacaaaaggcgcacacccctgctatccacacggttaataaatcgttcgcgctgagcaccgccaagaggatcatgatgacggcccggcccgtattgcacaaatacaagatcgacttttttcggaataaatcaatcagcggtcccgccagcacgccaaatgtcaacggcacgagttcgataaaagaaataacgccgacaagaattttactgccggtcaattccagcactaacagcggcagtgcaataagccagataccgtccgccgctgaagaaaacacctgcgcacaccaaagctttgcatagttcggtgttcgatatgtcatatcaggcccttttttgatcctcggcatcagaaacaccgccgaaccattccagcgttctccatgattcccgtctttccgtataatcctcttccatcacctcaaatacaatgccggtatcttgattccgataaagctcctgcaaagtatcggcagcccgtctcagcagctcctcagcgatcgtcccttcactcggatggcggccctcaaaacagcggacgccgccatgcgggaacgcaagctggcgaaatgagctgaagtgataatgtttaatgctctcttttatcgagagaaactgaaagaaatccgggtatctcagctggtcatttctgaacataagcgcggaagacaagtgagtctgataggtaatcgcccaatggcacagatcccacgtaataccgacatgcttcagatccagctgaaccagctctgtaaaatcctcaggataaatgaaaatcggatcaaaatcctctcccagattcccgatgatcggaaggttttccacaccgatccaaatgtccgtccctttcagctgctcatcaaactctgcgaaaaactcaatgatttttttacggtttccttccaggtcatacacttgaaattcctcaaccgtcataaattgattcgcatgaacggttatgcctttggcgccgtatttcacagcgagctccgcaaagtgataaagctgttttttgatgtgatcttcatgcacataatcggcatgatctgtcgggaaatgcagcgtcaataatgaaggatcaagctgttttgcatattccagcgtctgattgaatgttttgagataatccgcttcactaaaggagcggccgtcaaaaatattcgcttccagaccgtatcccgcttccacccatttctcatcgatttgcttcggatcaagtccgaaaaacggaatttgagcaatcataggacagtcaccatgttcctctcacaagcataaacgcttccgcagcggaaaaacccgattttgctccccatacacgggcattatgttcgattgcctgcaaagagcggggatgagggaagtctctgagctcggagccgtaacacgccatcgatttcaattttgtttcaagctcgtcttcaatattaacgaagaaattggcatgaaactgatccttctgacagtaattccattccgtcgaagacaatgtttcataggcaaaaacccgttttaccgtatggccgggaagcggacgggttgcggtcatgaccgctctgaatacgacggagtggtcaatattaatgtcaccgccgtactgggtatacacaatgtcaggctgaaaacgattgatttgtttctccgcttccttcacgacatccagcaaatccattgaatccattctgttatcaggaaggttcagcctgacaaaatcatggatgcccaaagtgctgagcgcttgttccgtttcttgagcagaatgctgcataacagactcttcaggcttctcataatccgtttttcttgatgacttgccttccgccataatgactgccgacacgctgtcaccttggcggacatgtttggcgagcgtgccgccgacgccgataatttcatcgtcgggatgcgctgcaaataccattactttcatcatattgccctcctttaactaacatttcagctgtatccgctccgcagttcatcagcatatcaagcatggagaggtgagggatatgctccccgaataattgaggatagtcaaaatgccggatctgctgatactcaatgacaattccgtttctttcaaaatcgctttctattaaatagtcggaaccctgactgcctgaataataacgatccgcccccagctcctgacaaagcgctaaaacaaaatcgctttttttctccttccggcattcaagctcagagacataacagagcggcgtttcgattcggagctcttttcggaaaaattcaatgatgtgcatattcaaatcatggagatattcccactccctctgatagacatcttgaaaaaaatgctggtaccgctcaaaatagggagctttcgcatagttcatcttaatcgccatccaatgttttttccgccaatcctgtgtctggtcgattttcatatgccgaagctctatgtctttatattgtttcatctgcaaaggcaccgtcagccatctggggccctgcggcgttttgattctgttgcggttcagaaacccttttttctcaaattgagccgtgtcatgaatggcaaacagatccgacttatacattttttcaaaaaaaccgtaccacggcagataactggattgatggccgcttattgttttcattccggtttcgtaaaaagtcggcattgtttttcttcagctccccaatatcgtttcggtcttgcgatttctttactgtgtgaatagccaaaatcagcccattgaagcttgcggcaaatggcgaattgcaaagcgtcacgcatcaacaagtaagaggcctgcgctttttttcccgccaggctgtttacattctgccaataatagaaatgagagcggtcatagagaaaaatactgctgctgatcagcgtctcatcctgatatgctccgacccaaaacatccggtccccaaacgtgtcaagcagtttttggaaaaatccttggctcagcacataagcagcgccgattgccgccgtatgctccttgtagaggtcgtaaaatgattcaagttcttgtcgcccgatcagcctggtgacaatattctctttttcagcgtatctgactgccgtccgggcttttccggaaatgcccgtccaaagttcgtcaaacgtgtccggaagcgtaagaatccgtgtcgccttttccgtccacccttccccgatttcttctgtaaaagaagtctgaccgtacggcagcagcatccgggatatgttccggccgaatatggcctcgatttcactttgaagccattcaaatgagatggggcgatctgaaataacgccgccgtatccgatcatattgccggataatacgcccttctgttcaaaaagcggaagatagatgacctgtcctccgtccgttgtcagtctgacagggtgaaatgacgtgccgggaagctcttccatgagaattccccaatcatagctttgaaacaaccccgcctgatacatgtcagcggcccgatcccatgcctggcggctcgtgcatactgctgttttttgcattgttatcaccactattcagtcttattcttttgctcacaatatgataaaacggattcggctatatatctgacttgctccttttgaagaggaggtttaaacggcagagaaagaactcttttccaaagcggatcttccccttcttccgccgcatatgtttcataaatcggaatacgtccgaggggaagatagttccagcatgtttggatgcctctttcagctaaataaacggaacacccgtaccgctcttcatcccgggggaatacaatcgttaaataattcagatgttctccttcttggggctggatcatctttatgccgtacgtctcttccgcctttataaagatttctcccgccgcttgtaagtttcggagcgaagctgttacaagctgatccataagtgaaagctgatcttcaataatggcttcccttgccggatgcatgcgaagcaccggtacaacagccggtttatccggcagagcttcgagcttagtggctttcatggaaggcatgatgcccgctttcctataaatatatgaaacgggatgatgccgtttccgtttcataacagcctgtattctttgatttctgatataaattcgatagtcagctgccacttggctgcgctgttccatcgggaaatttgctttttgccgaagccattctttcggcgcgattaacgcgccgcctccgatactcgcaagcggttttgacgggccgaagcttaaaacaccgaaatcgcccagaccgccggcatatgtatccgcttgttttgtaaacatggcttgagcggcatcatcaatgacaaaaataccgtgttccttcgcccagtcaatgatggcggtattttctctccggccgtatacgtgcgtgaggataaccgcacacgtctgccgcgtcgctctttttttgacatcctcaaacgataaagaaagatgctcatccagctgcgcaaaaacaggcgttgcaccggattgcaatacggcatcaatgacattcgggcagctgaaggatgagaaaatcacttctttccccggcccggctcccgaataagttaaggcgagcaccagtgccgcactgccgctggaggtcagcacaaccccttttccgtaccgtttttccagtttttcagtcagtccgctttgtccgccagtaagcaagtgcttcaccgcgcgcagacggtccctgacggaaagctgtccgggataaacgggatatttgactacttccgggttttcaggaaagtgaaagtttgtgcttttgtctttcatcttttatgatctccaggccttcattcagacttacttttggatcgtaaccgagtaaacgtttcgccttctcgattgacggcgcccgtttaaaaatctcgatgtcttttcccctcacgccgtcttcgcccagctttttaaacagatagttatccttctctctgccagagagcacattgactttttcagccagttcttttatcgtgatcggctggtcgttcccgatattaaagtcttcaaagacggctccttcatgaatgagcgcgagataagttccggtgacgatatcactgatgtagctgaagcagcgtatttgtccgccgtccccgtaaagaggcagctcagagccattctcggccaggctgaaaaacttgttgatgacaaaatcctcgcgctgtttcggcccgtatacattaaagtaccggacgacccgaatatgaagcttgtcggaagcctgttctctcaaatattcctctgattgcagtttggcttttccgtaagccgatttcggaagctttctgcttgtctcggtataaggaaaatcaggtgaatctccgaatacttctgagctcgatgagaaaagaagtgttctgattcccaattcaccgcatacctcggtgacatttttcgttccttcaaaattaacccgtatgacgtcttcttcattgcttcggcagctgtctacaccgaccattgccgccaaatggacaaccgcatccgctccccgcagtgattcgcggagggacgtccgatcaaggatatccgtttggcggtattcagtgtcaaaagccggctccttttggtctgcaataatggtgtgataacctttagcctgtaataatgccgccaattcgcttccgataaaaccggctcctccgataatcgcaatatgtttcatgatcctacctcctggctgatagtcaaaacttcttttatagacttgacaatatagctgcaatcctcatctgataactggctgtaaagaggcagtgacacgatctcccggaaaacacgttcagtaaccggcagctcggccggaaaatgtttttgatagtaaggatgcatatgcacgggaataaagtgcacgctcagcccgatctgtttttctttcattttctcaataaacagatctctgtccatgccgccgttctctcggatccgcaaaataaataaatgccatgagtgcgttatgccgttcggaatgtcagaaagcggaagcgctgctttgtcagattggcccgacagttcacgtacataaaattgagcgatctgtgcccgtttttcttgaatttcgtttgcgcgcttcaattgaaccagaccgagcgcggcctgaatatccgtcatattatatttaaagcccggcagtaacacgtcgtatctccagctgcctttttcaccgtaccggttccaggcattttttgtgatgccgtgccagccgtacagcctcgctctttctgcggcctgttcgtctttcatgacgagggctccgccttcccccgttgtaatatttttggtggcataaaagctgaagcacacggcatcgccgtgagtgccgatcatgcttccgttatattttgtaccgagcgcatgagcggcgtcttcaatcagatacaatccgttttctttacaaatggactgcaagttttccagatcagccggatagccggcaaaatgaaccgcaattaccgcttttgtgcgcggcgttattttcttcctgacatcttcaggatcggcacatagacttttctcgcatatatccgcaaacacaggaacggctccggcgtgcaggatgacattgacgctggaacagaacgtgaagctcggcacgatgacttcatcgccttctcccacaccgagcgccaataaagccatgtgtaatgcagcggttcctgaattacagctgatgacgtgttcggctccaatacattctcccagctttttttcaaaatcgattaccttcgggcctttcgaaatccagcccgactgaatcgtttcggttacgcttgcgatttcttcgtttgtcatatcaggtctgtgaaaagagataaatcgattactaatgaccgttccctcctataaagtgacaactctgcaattgtcggctgatttttccctgcatacatttcttgtgtcaaagataatcggtgaggcatccttcaaaatactgtagtcgattacatcgtgatctgtatgaatgatgatgacgtcgtactgattgatttgttcttttgtgaaagggacagattgtttgcggcttccgtcattcaagcggatctcgctgataaacggatcatgataatcaatcgcgcatcccttgtccatcaattcttccattatcgtaaacactgaggattcacgcgggtcatttgtattttttttataagcggcccctattattaagatgctgcatttgtctttgcccgccagtttcaaagcatagtcagagacagaaatcggcatgttagaattgatttcgtccgccagatcaattaattttgtctgcagccctttttcattcgcgatccatttgaagtaaaaaggatcaatcgggatacaatggcctccgactccggggccagggataaatttttgaaagccgaacggcttcgtgtccgccgcgcagatgacttcccatatatcaatatcaagttcacggcaattaagcgccatttcattgataagagctatattgacataacgataagtattctctaggagtttagctgtttcagctacttcgggtgaggtgaccgggtgaatgcttgtaacaatggtgttgtaaaacgctgaggcaagttctgtgcaagtctgtgtggttccgccgactactttaggaatatctgaaacttcatattgcctgttgcccggatcgattctttccggagaataagccgtaaaaaagtctgttcctattttcatgccgcggcttgatgccattctgtcggcaatcttttttttcgttgttccgggataggtggtgctttctaaaattaaaagctgatgctgccttccataagcgatcatgctgtcaactgcactgtcgatgtaggttaaatcggggatcttgtcttttttgttcaggggtgtcggcacacatatcacaatgatgtcgcatttttggatgagcgacatgtcggcactgatttgaaagcgttttgtttgtaaagccgagttcagtctgccgtcctctatatcttgaatatggctgcttccggcggctaacaaggaaaccttttcactgtttttgtcaaatccgatcacattgtatcctttatcgacacattccagcgcaagaggaaatcccacatatcccatgcctaacacgcctactatcgcctgcttcgtttcaatcagatgtaacagccgtttttgaccaaggttgctggcttcttttgtgacagtattcatttttcgccccctaatagatagaaaagagtattgttttttacaatttaaaacaaatatcgatcgatatcgcaattataacaaaagttaaaatttgataaatgagttttacatccttttgtgaattaggtattatctatttatttttcttttatttgtaaaataaaatcctgttaaatggtatatatctggtaacgagtgagaaaatctcccttaattgatagaatatacagaaaataatataaaaaaacaggccgaagcctgttttttattccttcattgcctcagttactgccgcggaaacgagtgctccagctttctctagccgttctttgctgatgtgtttcatattatcattttcggtgtggtaccagggccccggctcctgtgtatcggggctgagccaaatccagttagccgacggaatccccgcttcataaaaagagacatggtctgagtaaccgagctgaatcaggtttggcttgaccaaccgggatttttcagcggctttttcagcataccggacactcgggtttttcctgccgtcaggagtcgtgacacacatttgactcgcttcttcccagtcagtcgcaatcatatcggcattaaaattggcccggctgtgctttctttcattgttcgtgagtgtactgacgtaataagatgaacccgcagaccataattcttctgcaccgaacaggataaagcggatctctttgtctttcggtatatgtttgagttgcttgctgatttccagaacggcagatgtgcctgaggcgttatcatccgctccgggcgcgccttttacgctgtcataatgcgctgtgacataaataatatcagcatcagaagagttggcctgtgccgctttgcgcgttcctataatattttgtgaggtgcggtttttatagtttttaaattgaatgactgccttcttttcctgaagcaatgcttcaccgtcttcttttttcatacccgccgccggtatcgtgattcctttatcggtatgcggacggacggcgagcggttttgttgtctgattataaataatgactgctttggctcccgcttgttcggcatgtttgatcttttgagaaacagggatctttccttcgcgtatcactgcaatctttccttcggctcctgttacgtcattgcgtgatccgcagccgccgtcaaaaatcccgccttctattttgagctctttttcaacagcggattgatcagcggagcggagcgggaattcatgatctcccgctgtgactgaacctgaaaagtactttttcaatggaaatgactgtactttgacactggcgccctgagcccgcagacgattcgatatgtattcagccgcttccttttctttcgcagttccggtttcccgcggaccgatggtttcactcagatcatgcatagtgtccaatgcctcatcagcatcaaaaaccggcgcggtcacagttgaataagcatgagtttcggacagcggcccggcagacgcgccccatatgacgcttgctgccaccgcggctgacataaatgaaaatttcatcataatccctcctcttattaacacctcttccctttcgattgaagaacactgattcctttaaaaaggggaaaaatgaatattattgaccaaatgaagatgatgaaaaaggagggaaaagcccgggaccataaaaaaacgccgggagatattctcccggcgtccattacattacttatttaagttatagaaagagttgataccgtgatattgagcagtttcagccaactgatcttcgatgcgaagaagctggttgtatttcgcaacacggtccgtacgggacggagcacctgttttgatttgtcctgcattagttgccacagcgatgtcagcgattgtgctgtcttcagtttcaccggaacggtgagagataacggcagtgtagcctgcgcgtttcgccatttcgatcgcatcgaatgtttcagtcaatgtaccgatttggtttactttgatcaggatagagttgcctacgccgtttttgataccttcagcaagctttttcgtgtttgtaacgaaaaggtcgtcaccgacaagctgaacttttttgccaagacgctctgtaagaagtttgtggccttcccagtcgttctcgtcaagtccgtcttcgatagagatgattgggtatttagaaaccatttcttcgtaccagtcaaccatttcagcagatgttttcacaacgccttcgccagacagatggtatttaccgtcttctttgttgtagaactcagaagatgcagcatccatagcaagcttcacttcttcgccaggtttgaagccggctttttcgattgcttcaacgattgtttgaagcgcttcttcgttagaaccaaggttcggagcgaatccgccttcgtcacctacagctgtgttcattcctttagcagaaagaactgatttcaggctgtggaagatttgagcgcccatgcgaagcgcttcacggaagttaggcgcgcctacaggcataatcatgaattcttgaatgtctacgttgttgtcagcatgctctccgccgtttacgatgttcatcatcggtacaggaagcgtttttgagttgaatcctccaaggtattggtaaagaggaatctgtaagaaatcagcagctgcgcgcgcacaagccatagatacgccaaggattgcgttcgcaccgagtttgcctttgttttcagtaccgtcaagctcgattaaaagctgatcgattgcgttttgttcagttacgtcaaagccgagaagctctggagcaatgatttcgtttacgttgttaacagcagttaacacgccttttccaaggtaacggtctttgtcgccgtcacgaagctcaaccgcttcgtattcacctgtagaagctccgcttggcactaatgcgcggccgaaagctcctgtttctgtatatacttcaacttcaactgtcgggttgccgcgggagtcaaggacttcgcgtgcataaacatcaacaatgtatggcatgagtttgtctctccttttgatttacgcttatttttgaattaaagatgttccggtcatttctttcggtttttcaacaccgagaaggtctaataacgttggtgcgaggtcgcctaggattccgccttcgcgcagcgtcacgccttctttcgtcacaatgacagggactgggtttgtcgtatgggcagtgtgcggttcgcctgtttctgtaatcagaatgtccgcattaccgtgatcagcggtaatgatggcatgaccgcctttagcgataatggcgtcaaccacttcgcctaagcattcgtccactgcttcaattgctttaatcgtcggttcgaccattccggagtggccgaccatgtcagggtttgcaaagttcaggatgatcgcgtcgtgcttgtcagccgcgatttcttttacaagagcatccttcacttcatacgcgctcatttcaggcttcaggtcatatgtcgcgaccttcggcgagttaatgaggatgcgctcttcgcccgggaattcttcttcgcggccgccgctcataaagaacgtaacgtgcggatacttttcagtttctgcaatgcgaagctgttttaacccgtgctgtgctaatacttcaccgaccgtattgtcaaggtttaccggtttaaaagccacatatccgtcaacagattcactgaagtgagtcaggcagacgaaatacaggtttttcggatgattttcaccgcggtcgaaatcgcggaaatctttgttggtaaacgtgtttgaaatctggatggcgcggtctggtctgaaattatagaaaatcacagaatcgccgtcatgaattttcgcaatgggttcaccgttttcttttgtgatgacggacggaatgacgaattcatcatgaatgccgttcgcataagaatcgtcgactacatccatcgcgctgcggtaagacgggccttcgccgtaagccattgcgcggtacgctttttccacacggtcccagcgtttgtcgcggtccatggagtagtagcgtccggaaatgctggcgatttcgccgacaccgatttcttcgatctgctcattcagctgctgaatgtaagttttcgccgtttgcggacctacatcgcggccgtcgaggaaaccgtgaatatacaccttcgtcagtccttcacttttcgcaagtttcagcagcgcgaataaatgattgatgtgactgtgtacgcctccgtcagaaagaaggccgaacaggtgcagcgctttgtcgttgtctttcgcgtttttgatggcgtcaaggaacgtttgattgcgttcgaattcgccttcgcggatggcaacgttcacgcgtgttaagctttggtacacaatacgtccggcgccgatatttaaatgaccgacttcagagttccccatctgtccttcaggcagtccgactgcttcgcctgatgccgtcagcgtctgatgagggtattggttccaataacggtcgaaattcggttttttcgcttgtgcgactgcgtttccgactgtttcattgcgtaatccgaacccatcaagaatgatgagtgcagctggttttttactcatattgaccttcctccaataattgaacgaatgactgcggttcaaggcttgcgccgccgaccaaagcaccgtcaatatcggactctgccatatattctttaatatttgcaggttttacgctgccgccgtattgaatgcggagcttgtcagcagtttcctgactgaagctttcagcaacgactttacggatatgcgcgcagacgtcgtttgcatctttcgctgtagaagatttgcctgttccgattgcccagattggctcgtacgcaataacggaagcagcaacttgctcttcagaaagacccgcaagcccttttttcacttgatcggcaacaagatcatttgtttttccggcttcgcgctcttcaagcgtttcacctacgcaaatgatcggcacaatgccgtgtttgaaagcggcatgcgcttttttgttaactgtttcatcagtttcagcgaacatttcacggcgctcagagtggccgatgacgcagtaatccacgccaaggtctttcagagcgaccgggctgatttcacctgtgaacgcaccgttttcttcaaaatgcatgttttgggcgccgactttcaggtcagttcctttaacagcagaagtcagcttttctaagaaaagagctggtgcgcaaacaacggcttccgctttgtctgctgctggaatggaagatttcacttcttcaacgaagctgacagcttcgccgagtgttttgttcattttccagttaccggctataattggttttctcatctgttccacttccttatagcagtttttatttatcgttcagcgcagctacacccggaagctctttgccttccatgaattcaagggatgcgccgccgcctgttgagatatggctcattttgtcagcaaggccgaatttttcaacggctgccgcagagtctcctccgccgatgacagagtatgtatcgtttgcctctgccaatgcttcagccactgcttttgtgccttgagcgaacaagtcgatttcgaatacgcccataggtccgttccatacgacaagtttgctgtttttgataacttcagcgtacgtttcgcgggttttcgttccgatgtcgatcgcttctaaatcacttgggatctcagagatcggcacgatttgaacgtttgcatcgttagagaaatcatcagcaacgagaacgtcttccggcatatagaatttaacgcctttttctttcgcgcggtccatgaatgattttgcaagttcgattttatcttcttcaagaagagatttaccgacttcatagccaagcgcttttacgaatgtgtaagcaagacctccgccgatgatcaggttgtccactttatcaagcagactttcgattacgccgattttgtcttttactttcgcgccgccgatgattgccgtaaacgggcgctcaggatttgtcacggctttgccgagaacgtcaagctctttttccatcaggaatcctgcaaccgccggcagatgctcggcaattccggctgtagatgcgtgagcacggtgggcagcaccgaatgcgtcattgacatatacatccgcaagctcagcaaatgctttagcaagctcaggatcgtttttctcttcaccagggtagaaacgtacgttttccaatacaagaacgtctccgtccttcatatcagaaatttgtgcttttacagcatcgccgtaagcttcatccgcttttttcacttcttttccgagcagttcgcctaagcgtgcagcgacaggagttaaacgaagctcctcaaccacttcgcctttcgggcggcctaagtggctcgcaagaaggactttcgcgccttggtctgcaaggtgtttgattgttggaagcgcagctcggatacgagtatcgtctgttacttccccgtctttcattggaacgttaaagtcaacgcggcagaatacgactttgccttttacgtcgatgtcttttactgtttttttattcatgccttaggagatcctccttcaaaatggtttgcatagcacgaaaaacgtgaaacgtgaaaccgcctcatgatgcttccgccgcggggcagattgcagcttccgggcacggggcagatcgtcttctgagccagggcaggcggctcagaaaacgaaagtgccgcggaaacttcaaaacgcggacgttctgcagcaatccggcgctttctgaaagccggttctcatggaaaaagggaaagggagtccgtccccttcccttgtccgctttcattatagcgtttctgtccgaaagaaccaagtccggccctttccgggagctatgaattaaagaccttgttttgcgatgtaagctgcaaggtcaacaacgcggttagagtagccgctttcgttatcgtaccaagagattacttttaccatgctgccttccataaccattgtagaaagagcatcgattgtagaagagttagcattgccgttgtagtctccggatactaatggctcttcgctgtagccgaggattcctttaagatcgccttcagccgcttctttaagagctgcgtttacgtcttcagccgttacgtctttgttaagttcagcaactaggtcaacaagagaaacgtttggagtcggcacacgcatagctccgccgttcagtttgcctttcagttcaggaagaacaagggaaactgctttagcagcaccagttgatgtaggaatgatgttttcagctgctgcacgcgcacgacggtagtctttgtgcggaagatcaagaatttgctgatcgtttgtgtaagagtgaacagttgtcatcataccgcgtttgatgccgaatttgtcgttaagtacttttgcaaacggcgcaaggcagtttgttgtgcaagatgcgttagagataacatggtggttagccgcatcgtatttgtcttcgttaacacccataacgattgtgatatcttcttcgttagcaggtgcagagatgataacttttttcgcgcctgcttctaagtgtttcgcagcgtctgcgcgttttgtgaagaaaccagtagattcaactacgatttcaacgccttgtttgccccagctgagtttcgcaggatcgcgctcagcagaaacttcgattgttttgccgttaacaacaaggttgctgccgtcaactttaacttctgcatctaattttccgtgtacggaatcatattgtaaaagatgagcaagcatgttagcgtctgttaaatcgttaactgctactacctcaacttcaggattgtttaatgctgcgcggaatacgttacgtccaatacgaccaaaaccgttaataccgacttttactgccatgattatttcctcctttaaataagtgagagatatttatattgagggactgttatcccttaataacttctttgcggctccttcgtccgtgacgagaaccgtgtttcgctgctttttaaaataagcttcgattgcttctgcttttgatgatccgcccgctaccgcgataatgtcgggaatggcatcgaggtcatcgagctgcattccgactgaatgcaccttgtgaacgacttctccgtccgcattaaagtagtagccgaatgcctctgtcaccgcatgattgtcatctattttcttcaaatcttccaaaggcgtgtttcttcgctccgccattgttctagcttcgccgattccgtgaacgagcatactcgctgatttaatcgtgtgaagcacctcttttacggaaggctcttcaataatagatgagtaggcgccttgtgacagctggccgggaacgaacaaaagccggtaagtgcctgaagccttttccgccatatgcgcgcatatggtgttcgcctggtttttcacatcttcgcctaaaccgcctcttgcgggcacaaacaggagctcgcggttttttgaatccggcgtcatcatatcggcgacggcttcaattgtcgtaccgccggttacagcgacgatatttttgcctgaaaatctctttttcatacatgcaacggccgctctccctaattcttttttgacccaaggagattggtcgctgtctccggaaacgataatggcgtctttcagattgagccgctcttttaatgtcttttccaaaagcgtcaatcctaaaacatccttcatcgtatcttccagaatcgaaagcagtgaatagccctcttccgtcattgtcatgccgtttgttttaatatcgatgagattttgttcttttaagaactgaacctcgcttctgagaacgcgctcggtcaatccgagactggctgcaagacttctgcggccgatcggttctgtaagcctgatatactgcaagatttcaaatcttttctgcatcacaagcaaaagatcaggcaataattttttttgagcttgtattaactggttcatgactcaaacgttccttcctattcatactggacagaaaatgtcccgctatgacaaaaaacgtcccatcatagccaaaaaaaattatgtctgctttctttaattattttaacaggatgacattgttaattcaactgttaaaggtcaattcctcgacattcttcgcaggatttaccagtatctccttgatacagtcattatatacagaaacggaatgaaggtgacagacaaaagcccgccgcagcggacttttgccgtaaaacgctttcattttatccagagtttttctatttcttctaatgatttatttttcgtctcggggcagatcgtcacgacaaacaagaaacagagaatattaatgacggcgaatatccagaaggtgtacgcgagccccaacccgctgatcatcatcggcacgaactggccgatcgcccagttggcccccataagaatatcgtcgcaataccggcggcgcgtgcgcggaggtggttcggaaagatttccgaaatcatgatccacgtaatcggcccgactgatacgcagaaagcggcgacgaatcccaatatgatgacgactaaagccggaccgctcgccagctgaaaataaaaggatgccccgattaagatcatgaacagcgccataaaggcagatccgacccccatcagctttttccggcctaccttatcgactaaaagaaccgcgataatggtgaaaatcacttcaacgacaccgacgatgcatgtcgtgataaaccccgcattttgtccgaagcccatcattttgaaaatttccggcccgtaatacgtaattgcgttcatgccgatgacctgattgaataaagccagcagaatcccgatcacaagcgcttttctcagccccggtttaaacagctgagacaatgaacccattttttctaattgtaaagacgtttcgatttgtttgatttcttctttcgcggtctgctcgccattaatgcgcgtcagcacggtgagggcttcattccggcgccccgctttcgcaagccagcgcggactttccggcacgataagcagcacgataaaaaagatgacggacggaatcatgccgtaagcgagcatccaccgccagccggtgtgcaccccccattcatacgagccggactgctggacggcaaggttaataaaataagtgccggagatccctaatatcgtaaacagctgatacagtgaggaaagactgccgcgtatggccggcggagcggcttcggtaatatacgtgacagaaagcgaggagcccatgccgattcccagaccgccgatgactctggcgatcactaaggaagacacactttgagaaagcgcagagacaaccgctgacaccgcaaacaacagcgccgctgccatcaatatctttctccgtccgaaccggtcacttaaaaatccggaaattccgacgccgaaaacaccgccgatcataatacttgaaatcacgagcccttccataaaaggacttaagcggtacaaatctttcaggaaaccgatggcgccggaaatcaccgccgtatcataaccgtacaaaagccctcccagtccggccgcgcatgagatgagaatgacaaaccacttcgaatgctgccgagtgacaggtacatttgagccaattggtgccgggtgattcttcatgaattttaccctcccgcgaataatagaataaaaacgcttacaaaacaaagtgcggcgcttgagttgctttgttttcttcagaaccgccacatttgtacgtacttataaagaattttatctaaaaataaggaaaattagtacgtacaaataaagaataagcagtttttcacaatctgtcaattatttttacagcttgatgaaagggcttactatgttatactggaatttgtccgtatacattttggaggaattgatatgctaccgaaatatgctcaagtaaaagaagaaatttgttcatggctgaatcagggaaaaatacagccggacgaaaagctgcctacggaaaatgagctgatgcagcagttcggggtcagccgccataccatcagaaaggcgatcggagatttggtctcgcaggggttgctgtacagcgttcagggcggaggcacctttgtcgcttcacgcacggcgaaatcagccatgcattcaaacaaaacgatcggtgtcattacaacgtacatatcagactatattttcccgagcatcatcaggggaattgaatcttatttaagcgaacagggctattccatgctgctgacgagcaccaacaacaatacagaaagtgagcggcggggccttgaaaacctgctgtccaaaaatatagacgggctgattgtcgagcctacgaaaagcgcgctgcagacgcccaacatcggctactatctcaacctggagaaaaacggcattccgtttgccatgattaacgcctcttatgcggagctggccgcaccgagcttttccgtcaatgatgtcaaaggcggcatgatggcttgcgaatacgtcatgtccctcggccacacgcacattatgggaatctttaaagcggatgacacgcagggcgtcaaacggatgaacggctatcttcaggcgcaccgggagcgcgggatttttccgtctccggacatgatcgtgacttacacgactgaagaaaaagaaaccgtgcttcttcaaaaaattaagcatacccttgagcaaaacagcggatcatacccgacggccattctttgttataatgatgaaattgcgctgaagacgattaatcttctcagagaattcggcttaaaggtgcctgatgacgtgtcaatcatgggctatgatgattcacatttcgcccagatttccgaggtgaagctcacctctgtcaagcatccgaaatccattatggggaaagcggcggcaaaatacgtcatcggctgcttagagcataaaaaaccgaagaaggatgacgtcgtgtatgaaccggaactcgtcatccgaaattccgtcaggcggatcggcgaataaaaaaagcaatgtgcgcggcacattgctttttttgctcagctgttttttaattcggcgatgatctcaaatgatctcattctgtcggcatgctcaaagctttctgaattcaccatgatttcatccgcctgtgttgtccggatgaagctttccagcttttccttcacacgctccggtccgccgacgatcgttgaactgagctgttcattgaccatcgctttttcatacggcgaccagatttgatccatgtcttcaacaggaggcttcagctggttcggcgtgccgcggacgaggtctaaaaatctttgataatgcgatgtcgccagatgctccgccttttcatccgtatcggcggcaatgacggtgacgccgaccatcgcgtacggttgatccagtacgtctgacggacggaaggagcttcggtacagctcaagggcgggcacggtgtttttcggtgagaagtgagccgcaaaggcgaacggaagcccgagctctcccgcaagacgcgcgctgaagccgctcgatcccaaaagccagatcggcacgtccagcccttcgcccggaatggcgcggacttgattgcgcacattgcctgagggtttgaagtaatttctcaattcttcaagctgctccgggaaatcctccccgctgtttatgtttcttcttaaggccctcgccgttaattggtcggtacccggcgcacgcccgagtccgaggtcaatccgccccggatataacgtttcaagggttccgaattgctccgcgattataagtgacgaatgattcggcagcataatgcccccagaaccgacgcggatttttttcgtgccgccggcgatgtggccgatcagcaccgccgttgccgagctggcgacaccttctatattatgatgctccgccagccaatagcggttatagccccactcctcggcgcggtgcgctaaatccatgctgttgcggaacgattcagcaaccgttcccccctgtacgaccggcgataaattcaatacggaaaacgcagtatctttcaatgtatgttcagccatcgttttctcctttatggtttagtgtaagcagatcttaaacaaggtctctaccacacaccttaccacagcttttcccgtgagttaaacaatttgattcgatgatcttcgaacaatcagtcagcggtcgtcactagtgaactctgtatgaatgaatctattacattcagatatgaagagcctagaatgatataaaaatgaaaagatatcattgaaagaacagaaccaataatgttaacatatgtcatatattgaataggaaggaagtcatagtctatatgcgtaaaaaaatcttaatggcactcacaacagctttactggcagcaatcttctttaccggaaacaccgataaggcatatgccgcagacttttattccggcactcagcagcatttaaatgtaagcggatttaccgatgcctcctactacacgaaaaaagcgaaaagtgtcgattttactctcagtacagcgtatccgtcagatcgaacctttaaaggaaacctatacttacagcgaaagtccggaaagaaatggacgacttgcaaaaaaacaaccttttctttctcagtaagggtgactaagtcattctctttaaaaggatgcaagacaggttattatcgtgtcaaagctacgttcagcggttcaaaacttgtcaatacgacaaactcttttaaaattaaccgataagattcagggccctaagatcattagggcctttttattcattctttgtgagctcctgcgcgatttgaataaaaagttttgccgccaatgaagcctcttttacagaaggaacggcaagcagaacatcacggtacaccgcctgattgagttcccttgtcacgacattttccggcagtgatattccggacatagacatttgtgataatatcgcaattcccagcccctctttgatcatgctgatggacgtattgacgttgtaaacagtgaatgcggcagtcagcacagaccctgcctccttaaacatatcaataaacggtgattcgtatcctccgtcacagatgatcatcggctggcggtcaagatctttcagagtaattgactcacagctgcaaagcggatgatcatttctaagcacgacggccattttatcttttttcagcggcagatattccatgtcttccgtaggaaaaagagtgatccccacatctattacccgggagcggagccattcctttacttcgttaaccgttccttcataaagcaccaactcaagtttcggataccgttttttaaacacgctgatcagttttggaatgaaataagcggaagcggccggaaatgtgccgatgtgaatcgttccctgttcaagccctctttccgcggccgccagctgctcggctttttctatgcctttgagcacctctctgatatgaacgagaatttttccgcccgtgtccgtgagccttacgccgttgcggcgctcgcggatgatcagcttgatgccgagctctgactcaagcgccgagatggcatggcttacggcgggctgtgtcatattcagcgcctgccccgcttttgtaaagcttcccgtttcagcgatttgaacaaaaacccgcagttgtgtaatcgtcataacgttttacttatgctccttataaaaaagattcattttatttatcttactgattaccgtatcatatgatggaattgttctacaaggagtgaacgacgtgaaacagctttcgaaaatacagacggctcttatgctggcgtttctagtcacggtatggggaattaactggccgctgacaaaagccgcgctcgcctattcgccgcctcttctgtttgccggaatccgcacgctgatcggcggacttctattattaatggtggcgctgccccgttttaaaaagctgcgttttaaagaaacgtggccgatctatcttatttctgccattttaaatattactttattttacggcctgcaaacggtcggcttgaattacctgcatgccggcttattttcagccatcgtgtttttccagccggtgttaatgggcgttttttcttggctgtggctcggggaatcgatgtatcctttaaaaatagccggtcttattctgggctttgccggtgtcgccgtcatcagcgcagccggtttcggaggccatatttccatcgccggcattcttttggctctgggctccgcggtcagctgggcgctcggcacggtatatgtgaaaagaacgggcggacgcgcggactctatctggatggtcgctcttcagcttctgatcggcggcgtgctgcttgtcagctccggccatttttcagaaagcttttcagcgattcaatggaaaactccgttcattctcagccttctgttcatttcggtatttgtcatcgcactcggctggctcgccttttttacgcttgtcggttcaggggaagcaagcaaggttgcctcttacaccttcctgatcccgctcatatccattgtcgtcagctcgatatttctgcatgagccgctgaccgtcagccttttagccggactgcttctgatcgtcacaagcatttgttttgtgaatataacaccgaagaaactgaaaacacctgctctggccgcagaaaaaaaggccgttcattaaaaaaactcttgccgcggggcaagagtttttttatttattgacgtctccctttcacgagatacgcagccgtaatgagcaggtagatggccgcagtgatgcatgtgatgacgatggacgtcgtcgcaattacgccgatcaggatggccaaaagcgcaagcaccgcgaaccatgtcgtgtacgggaaccatttgacgtaataagccggctgttctgttgaatgttttcttgattttaaatgggcgaatccgataatcagccagatgaacagcacggtatagccgagggaacccatcaaataattaaacgtccggcttcctgcgaataaagaaatcaggacgcctacatataaaaatgacgtacaagtcagaatcgcatagacaggaacctttttcttcgatagttttgaaaagattttcggcacccggccgtcagaagcctgcgtaaataagacgcgggatgatccgtacagtcccgagttcatagacgagataatcgcaagaagaatgacggcattcataatatggtcggcacccggaattccgatcatcttaaatactatgacaaacgggctttcgggaacgctgttgacttgattccaaggaatcaggctgacgatgatgaaaaacggcagcaagtaaaaagcgacaatccgcgttaacgtgcttcggacagctttcggaatcaccttttcggggttttttgtctccgccagcgtgacgccgatgatttccgttccgccgtatgagtagatcacgacgagcatcgccgtaatgacgccccccgctccatgcgggaaaaaccctccgtgatccgttaaatgagacagccccggcgccgtgtgattgccgaatgagaaaaataatagcagaattccgcataaaataaagatgacaatcaccgtaattttaatgagcgcgagccagtactccgtctcggcaaacagtttcacagaaagcatgtttacgaccgtcaccacgatggaaatgatcaaagccagtatccatatcggacattccggcagccaatattgaatgaaaatggcggctacgaccgcctccgcggcaatattgagcacccacattttccaatagatccagtctaaaaagtatgcagcgtacgaaccgagagactgctgaaccaaatcacggaacgtccttgcatgtttgtttctgacggccatttcggccagcccctgcataataaacagcagaatgattccgccgaggaggtaggccaacagcacggacggccccgcttcatcaatcgccgtgctgctgcctttaaagagcccggccccgattgcgcctccaagcgccatcatcataatgtgtctggacgacatcgtccgttttaacgtttgcttgtccttttccatctatcacacgccctctcgcaaaaagtgttcatcacataaaaaagcacgccgcctctttaggaaaagagacggcgtgcctcaggcagccgcggtaccactcttgttgatcccgaatatccggaatccagcttaaaaaccttttaacgaaggtcagccgttaggacatagggaatattccgacaattccgttccgccctgccacttccgggcgagttcaaagaacaatcagtccgcgtttcaccaacccgcggctctctttttctgactggattctcttactgctcccgttcacagtgttttatgttaaatgaatctcttgagtttttattttctgaatatagtaacataatatacagtcttctattttcaaagtcaatactaattttttccgtctattgtccttcccggtgattcggaaatttcagctgaaatccggacacaaggctttgctttccggcgccatgctttccgctttcacctttgtgtttgcgtataaaaacagcgcaagcgcaatgccgaatgatatgacgagaatccatgcttttttcattcagatgcctcctcactttctatcatcggcggctttttctctttttttacacacaaaattgaaaaaacaattttaaaattctgttttccttatattgaaacttgctttatcataaaagtatgcgtttacattcgagtagggaggttatagtatgacccctgtgaattcaagcagcatcgggaagattcaggcggccagcaaaggtttgtcgccaaaattgagagcgattgcagaccatatcgtgaaggaaccgaaagacgtggttcacctttccatcattcagctggccgaaaaaacgaaaagctctgaagcgacgattttcaggctgtgcaagcggctcggtttttccggctatcaggatttaaaaatcgcgctggctcaggagatcgttcaggagccggtgcagcacattcatgaagaaatgagccccgacgacgatatcgaagtcatcatccggaaagttttccgcacaaacatttccggtctgaccgatacctttcaattattagatccggccgacgttgaaaaagcggtagaaatgatccaccgcgcagacagaatcgaattttacggaaacggcggttccgggctgatcgccactgacgcgtatcataaatttatgcgtacgggtataaattgcatcgcgcatacggattctcactttcaggcgatgtcagcgggtcttctcggtcctgaaagcgcagtcatcggcatttctcattcggggagcaacaaggacgtgctcgacgcggtcaaaacggccaaatcgctcggcgccggcacgatcggcattacaagctaccaaaagtcgccgctcacccagatttccgacgttgtgctgtatacatcaacaagggagacggctttcagaacggaggcgatgtccgcaaggcttgcccagctgtcggtcattgatacactgtatttcgccacggcccggctgcggcaggagaaaacgctcgccaacttgcagcaaatcagaaaaatgatcgcgcacaaacgtttgtaatcgttttctaaatatttttttcaaaagagagaaagccgatacagcgggaattgaggcaattttatgaaaaaatttttcttcttcatcgttgatttataaaaaaattattcctataattgactttgtaagggcatacattataaatctatcttattattcaatcagattaggcgggatatattatgaaggaaacccaagctgttatcggtctggatatcggcacgaccagtacgaaagctgttctgttcggaccaagaggcaaagtgttagccaagcattcggttcactatgatttaatacagccaaagccggcatgggccgagcaggatcctgagcacattttggaagcggtgatcggaagcatcaggggcgccgtcacaaaggccggactgagtcctgacaatctgcttgcaatcggcatcagcaccgccatgcactcattgatagctgtcgatcaaaacggcggcctgctgaccaaaagcatcatttgggcggacaaccgcagcgccgagcaatcaaaacggattttaaaagagatgaacggttttgatatttataaaagaacgggtacgccgattcatccgatgtctccgctttccaaaattgtgtggatgaaagaacaggacaaggagacattcgcgaaaaccgccaaattcatcagtattaaagaatatattctgcacgagtttttcggaacttatgtcgtcgattattcgatcgcttcggcaacgggactgttccgattagatacgctttcctgggatgaagaagcgctcaggattgccggaatccgggaagatcagctgtcggacattgtgccgaccactcatcagctgcgcggccttgcgccggaaatcgctgcacggatgggcatccatgcggatacaccgtttattatcggcgcaaatgacggcgtgctcgccaacctgggagtcggcgcgatcggcaaaggcgaagtggccgttacgatcggaacaagcggagccgtgcgttcggtgacggatgcgccgattacggatgaaaaagcgcggacattctgttacgcgctgactgacaagcattgggtcatcggaggcccgacgaataacggaggcattatgctgcgctggcttcgagacgaattcgcttctccggaagttgaaacggcgaagcggctcggcattgatccgtacgatttaatgattgatattgctgataaagtgcccgcaggctctgagggattgctgtttctgccgtttttatcaggggagcgcgcgccgttttggaacccgaatgcccgcggaacgtttttcggcatcagcctccgccataaacgggagcattttatcagagcggtgctggaaggcgtcatcatgagcgtcttttcaatcggtgtcgcactgagagatttggcgggccccgcaaaagacgtgcgggcttcgggaggatttgcgagatcgccgctgtggaggcagattttgtccgatacgatgggacgcgaagtcctcgttccggaaagttacgaagcctctgcgctcggagcggccgttctcgctttgcacagccttggcgaaatggaacggatcgaggatgttcaggactggatcagaatttcgcaccgccatgaaccgaacgtcaaaaacagcgaaacatatattgagctgttttacttatacgagcggctgtatgacaagctcaaagatgaatttgacgtcatcagtgaatttcagctcaaacaaagccgttaattcttctttgaaagaaagggtgaaaaggtcatgttactgtttattgtcattgccgctattatcgttttactcttattgattacggtcgctaaattaaatccgtttatcagtcttttgattacatccatccttgtcggtttcgcaacgggcatgaatctgccggacattatcacttcaatgaaaaccgggctcggcaatacgctgtctctgcttgcgatcgtgctggccctcggtacgatgctcggaaaaatgatggctgaatcaggcggtgcggagcggatcgcccacaccctgatcggccgcttcggcaaaaagaaagtgcattgggcgatgatggccgtcgcttttattgtcggcatcccggtctttttccaggtcggcttcgtcctgctcgtgccgcttttgtttacgattgcgattgaaaccggggtttcattagtgacgatcgggattccgctccttgcgggactttccgtcgtgcacggattggttccgccccacccggcggcgatggcggctgtcggcatttatcacgccaatgtcggaaaaacgattttgtattctttaatcgtcggtattccgactgccatcatcgcggggccgctttacggaaaatggattggtaagcgcattcataaacccgttcccgaactgttgaaaaaacaatttattgaacggaatgaaaaacgcaagcttccgggattcgcaaatacattgtttacgatattggtaccggtgatcctgatgcttatggcaacgcttgccgaaattgcgcttccggaaaaaagcacgctctatgaaacttttaaatttatcggcgaccctgtcacggcgcttttgatcgccacggtttactcctttttcagccttggtttttatcagggctttgacagggaaagcattttaaaattcagcaatgactgtctgggaccgatcgcttccattctgcttgtgatcggagccggcggcgcttttaacaacgtcctgattgattcaggcgtcggcacgtatatcgctgacatggcgaagcactcaagcttctctcccgttcttttaagctggacgatcgcggcggtcatccgtgtcgccacaggttcagcgactgtcgccatgatgacggcggccggcattgttgctccgattgcatctgtcatgccgggcgtcagcagcgagcttctcgttttggcaacgggagcgggctctttgattctgtcacatgtcaatgactccggtttctggctcattaaagagtatttcggaatgacggtaaaagaaacgttcctgacatggacggcgatggaaacgattatttctgtcagtgcgatctgttttatcatgatcattaacgcgtttatataaaaacaaaccccggccgcaaaccggggtttgtttttttatcggtcattcacgaggatataagcggctttaacgggtccgtggacgccgacaaccaaatccatttcgatatcggccgagttgctcggtccggtaatatagttgatgcaggaaggaacggtgacgccgtctctgatctgctgtttcagtatatcgctggcctgtgtcattctcggcacaatggaagatttcgggatgattgcgatataggtggtcggaagcaggctgacggaacggccggcatgctctgacgcatacaaaacgacggtggctgattccgcaagcgtgatctcgctgaatgtgatgcccacattcgcttgttccgctttttcaatatttttcgctccttgttccgcgtcccattcccaaacgggaatcccttcgtccggccactcttctgtcataagggtctgcaagccgtacatttcaaaccggctgtcgttcggaatgatgacaggccccccttcaaagcggttcacctgcgtgcgcaaagcgtcgtaaagcccggctgcatccgtttcgatcagttcggtatgaatgttgacgcagtggtctttcagcatcgtgacaagatcgtcttccgtacagtccgcatgcgtttgatattgaggctgatacttccattcaggcagggacacgcctgatttcctgcgctctctgcccagacttccggcgatccggtttagaaaggattcctgatgtgtaaccgtccctttcatcatcattcttcccccttttgtttttcccggtctttaaaccaatctctgaatctcgatttatgcggcgccgggaagtcccgtattgccgtccattcttttaacggccccggcccttttgatattttgtcatcctccgtaaacggcgtcatggcggcaggcgcccatttcgatcccagtttataaagggacggggatgacgagccgagcccgaaggctttcatcgccagtttttcgctgatcggcgctttgccctctttttccacaatgttctgccgatgcttgagcagcagctcgtgcagcggaattttaaccggacacgcttccgtacaggccgcgcataaggaagatgcgtacgggagctccttgtattcgtcatatccgccgagaagaggcgataagacggcgccgatcggacccgaatagatggacccgtacgagtgtccgccgacatgccggtacacgggacagacgttgatgcaggcggcgcagcggatacattgcagcaccgattggaattccgtgccgagtatgcgggaacgcccgttatccacaaccacgagatgaaattcctcaggcccgtcagcttctccttgctgccgggggcccgtcagcgccgtaatgtaacttgtaagccgctggccgaccgcgcttctcgtcagcatgctgacaagcacttcaaactcagaaaatgaaggaacgatccgctccattcccatcacggtgatctgcgtcttcggcagcgcggacacaaggcggccgtttccttcgtttgtcacgagactgaccgatccggtatccgcgattgcaaagttgcagcccgtgatgccgacatccgcttcgagaaattttttccggagaacgctgcgcgcgtgcatgacgagctcttccggtttttccgtctgtttgtattcgagtctctctttaaacacgtcacggatctgctctttgtttttgtgaagagcgggagcaacgatatgtgacggcggatcgtgatcgtcaatctggagaatgtattcgccgagatccgtttctgtgacttcacagccctcttcctcaagcacttcgttcatattgatttcttctgtcaccatggatttggattttacgatttttttggcgtttttctgccggatgacatcgcggatataggaggacgcttcttccgccgtttcggcgaaaaagacatgcccgcctctgttggcgacgttttcggcgagctgttccaaatagaaatcaagattgtccagcacatgctgtctgatttcttccgcatgtgaacgccaatcctcccagtttcccaattcctcggccgcctgaagcctccttatcctgagccgttcctgcgctccggagacggctcctctcataaactcattatctattccttctgatacccgctctttaaaagcggcggtaccgattttcatcgccatgattttacccccttgttgtttctcgtcttatctgctgttcagcacttctgcgatgtgcatgactctgacgtttttatccttacggtcaagacgcccgccgatattcatcagacatccgcaatccgccccgatcagcacctcggcctccgtgtcttccacgcaggcgaccttttcatccaccatttgttcagagatttgcgccattttcacagaaaatgttcctccgaatccgcagcattggtgttttccgggaagcgcggtcagctcgagccccttgacatggcgcaaaagcttcatcggctcctccgacacgccgagcagcctcgtcatgtggcacgatgtatggactgtcgcttttttatgcagcaccgccccgacatcctccaccccgagaacgttgacgataaaatccgttaactcatatgttttgtccgcaagctgctgcgcttttgcggcccacttcggatcgtcctgaaacagatgcggatattcacggaacatcgtcgtacaggaacctgacgggctgacgacgtactccgcttcttcaaacgcggcaatcatccgcttcattgcttttttcgcatccgtcacatacccgctgttgtatgcgggctgcccgcagcaaatctgcccctcgggaaaatccacctcacacccgagccgttccagcacctcaaccgtcgcctttccgacattggtctgaaacatatccacaaggcacgtgacaaataatgagactttcatgatgaacccctctttcatcctcagtatgtgatccggtcatctgatgacctgtttttggaaagctctataaatatcctacactattctgaatatggattggaaggtttttctgaaaaatcctttcgcccgatgcgctgaagggtaaaaaaaagagaagcctgaaagcttcccatgcttctctagatcccgtttttcagcaggtgtcccagtttttgcacaccctcttttatcgcggctttaccgggaaaactgaacgacaggcggagatattcggcaccgtcttcctgatgcggaaaaaaatattttccgggtacataggaaacgccgtgagacagagccctcgccagcagtgcggacgtatcagcccccggcgctttcacccatacaaagtaaccgccttcaggcacgtgccaggatgcggattccggaagatatcgcgctgatgcggcgagcaaaacatcacgtttgcttcgatatgcttcccgcaaggcggcgagccgttcttcaatattcgtttgttccagatagacggcggtcaccgcttgggaaaacggatggcctaagtctttttttaaccatgacaatgccgtgatgaatgcggcgtcccctgcaatccagccgatcctcatacccggggcgatgacttttgataatgaaccggcgtacagcacccggccgttttgatccatggctttcaagggcggcggaatatcggtgaatccgagctcgccgtatgcatcatcctccaagatgagaaaatcatacgtttcggcaagctgaagcaggcgggttctccgcttcgatgacattacggttcccgccggattctgaaaagcgggtatcgtgtagagaagacggggaagcacaagcccttttcgttttctttcctcaagcataaacgctaatgtttctgtttgcagaccctcttgatctgtcggaatgctcatgatatgcggtgtataatttttaaaaatctcgagcgcttccatatagaccggagcttcaacggcagcggcggtttgttcatcgaggaaaacccgcgcagccagatctatcgcctgacaggcgcctgatgtcacgatcagctcatcgtcccggcagtgaatgccgcggatggctaaccgttcttgaatctgcttttttaaaacggccgtcctcgggcttcctatataatgcagcggcagatcacgctcctcatccagaaggcgggaggcggcttctttcagctccttatcaggaacgagcgcgggatcgggatagccggaatgcagagggatgcacgctttcggaactgccggcatccattccccgggaggatcatttgtcagagctttctttacatggtcagaaaaaaaagattcggcctgcatgtgatgttatcccctttcacaagtcagcttctatacattttcttcaaaataagcccccagcacttcttccacattcgtcaggtgcgccgtcatcgctgcttccgcttcatccgtgtctccggcggcgacggcgctgtaaatgcgttcatgctcttcatacaatcgctgcacgctcgttcgtttagaaaacagccaaatttttctcgtttctctcattgtttccaaaaggagcgcggagacatgattcatgagatgcttaagcagcccgttttgtgatgcttccgccagcgccatgtgaaaggagaaatctgctttttcgcccaattcttcgtctccgtcaatgtctttcatctccatgagagcttggcggattttttgtaaatcgtcttcggtgcgtttttcagcggccatggcggcgacgccgagttcaagcagctttctgacttcgagcagctgtttgacgtcctcttttttcatcaagagggcggaagaaagcggctgggaaacatgagacggctcaaattctcttatgtatgtgccttctccctgcttcatgtcgacgagccccatcgctttcaaagccgacagcgcttctctgaccgccgagcggctgacctgaaaactctcggaaagcgcctgaacagaatcaagcttttcccccggcttaagctcgcccgcttttatcttctccagcaatgcgtcagcgacttcctcgtagatttttttcgttttaatttgtttatatttcaacgcgatcaccccgtcacttgtgaatcttgatgtttatcgtctattatacttctttttttgtgtagccgacaggttcagacaatttgttcaagaaaagtattgtactttcaaaactttcaaaatataatgctaattaacccggtcatcagatgaccttatcataaaaagtaatcgtttacatgacataaggaggggttttttagggatgcaatggacacaggggtacgctcctttagggggaaatttgcttttatcggcagcttgcgcgctcgtgccgattatcttctttttttgggcgcttgcggtgaaacggatgaaggggtacatagcggggcttttaacgttagccgtttcacttttaatcgctgtatttgtttacggcatgccggcggaaaaagcggtgatgtccgcttctcagggagcggtgtacgggctgcttccgatcggctggattatcgtcacatcggtctttctgtataaaatcaccgtgaaaacgggacagtttgagattatccggagttcggtgctctcaattacagatgaccggcgtttgcaggcgctgctcatcgccttttcattcggggcatttttagaaggcgccgccggtttcggcgctcccgtcgcgatctcggccgctttgctcgtcggacttggttttcagccgctgtatgcggcgggaatttgcctgattgccaatacggcgcccgttgccttcggtgcgatcggcattccgattaccgccgtcgaaggtccgaccgggataccggcaatggaaatttcccaaatggtcggccggcagcttccttttttatccgtctttattccgctttacttaatcattttgatgagcgggtttaaaaaggcttttgaagtatggccggccattcttgtttccggcgtctcctttgcggccgtgcagtacgcaagctcgaattttttagggcctgagcttccggatgtgctgtcggcgcttgtttccatggccgcgctcgctgtatttttgaaattttggaaaccgaaaacggcctttcgtttcgcggcagaacgggaatcagcagcggccgctgaccgggcgccgatcaagtacgggggcgccgcggtgtttaaagcgtggtctcctttccttcttctgacggccatgatatccgtttgggggattcccggcgtgaaggctgctttaaccggtcattatgaaggaacgtcaatgtggctttcctggctgaatgcagccgggaaagcattgaccttcacgcctcccgtcccatttgtaaatcagcagattcttcaggcggacggcacgccgattgaagccgtgtacaaacttgagcttttcggttcagcgggaacggcgattctgattgccgccgtcatctccaagttcgccctcggcatgtcgtggaagacgtggggcgaagcgtttatagaaacggtgaaagagttaacgcttccggtcgtgaccattgtttctgttgtcggctttgcatatgtgacgaatgcttccggcatgagcacgacactcggtcttgcgcttgccatgacgggcgcgatgtttacctttttttcgccggtgctcggctggctcggcgtatttattaccggctctgatacatcggccaacctattgttcggcggattgcaaaaggtgacggcgctatctgtcgggatggacccggttctctccgttgccgccaattcatcaggcggtgtcaccggaaaaatgatttctccgcaatccattgcggttgcctgtgccgctgtcggtctggcgggcaaggaagccgaccttttccgctttacgattaagcacagtctgtttttgcttctgctcgtctgtctcattacatttttacagcatcatctgttttcatggatgatcccgtaacacggagaacctccccggggtttggctcggggaggtttcagctgtaccgttttctcgccgatgacggcggaatatttaattggtcacggtatttggcgacggtgcgccttgagattcggatgtcatattgttcatgcagcagatcggcaagcttttggtctgaaaaaggtttctttttatcttctttacggaccaatgcttccagatgcgcttttacggcataattggaggcgccgccgtcccccgatgattcagctttcgccgagaaaaatgttttcatttcatacagtccgtacggcgtctgaacgtacttccctttgatggcccggctgatcgttgattcgtggagctccagcgtttccgccacctctcttaaggtcagcggctgcattccgctttttcctgtgagaaaaaaggattcctgccgttcagtcaggacgccgataattctcgtgatcgtttgttttctttgcgacaaagcccggttcagccagcgccattcctgatattttgccgacagataatttttcgtgtcacggcacccggcggctgacaagagcggctgataatgggcatgaagctggatgtcaggaaacgaacggctgttgagccgcgcttgaatgatgccgtttttcaccgtgatgaaaatatccggttctacgtaaaaacccggctcctcatgcgcataacggagccccggcctcggatcaagcgcgctgatcatgtcagcgatgtcctgaatgtctttaagcggaatgcccgttttaagtgtaagcgctttccaattctttcttgcaaatagctcaaaataggcttcggcaatccattccgcctgttcgttccgctcgggcagacggcggagctgaagaaggatgcattcctgcaaagaccgggcgccgattcccgcgggctcaagggattgaagctttttcagaaccgcttccgtctcctcttgtgaagcggatacatggtcggcggcggctggtatgtcctcttttaaataaccgtttgaatccaatgaatgtatcagataattgaaaatttttttctcatcatcggacagcttcatgtctaaggcttgctgtttgagcgaatcctgcagcgttttgcgggtaagtctgatctgctggcttccgtcccgttctttcatcctgtttttatttgttttatggtaagatagtggcggcgtgtctgtttcctttcgttcaatcagagggttttccagtgagagctcatcaatatatccggccagttccgcggaattgtatccgagtaatgtgatggcctgtttaagctcttgcgttaattgaggctttaacatttgtgtttgctgaagtttgatatccatcatgctcactccccttttttcattgtacatgattggtttcataccgtatatacttattaaaaggagttgctttatagatgtcagaacttttttctgttccctattttattgaaaactttacacagcacattgaaatgaatccgaatgaagaccgaattcatgcgatgaacagctattaccgctccgtcgtctcaacccttgtacaggatcagctgacgaaaaactcggttgtgctcaaaagaattcagcatttggatgaggcgtacaacaaagtaaaacgcggagaaacaaaataaaccttccgctcattcaaagcggaaggttttccttcgtgccggcggtttcaccgatcagccggacgtccggcgcttcgtgcgtccaggtgtaataatagttcgcgtttttcccgtatgaattatcaatgacggtattcggtttcccgagaagcgaggacaggatgtggccgtggagccttgacgtttccaccgattcgtacctgctgaaaaacaggaccgcttttttcgttaagaaatcggaatagcggttccaaaaccgcgcaatcggcagcgggtttcccgcttttttattcaaaacattcagcgtttggaaaaaagcgattcccctgcggtcgcttgctgacagaacatcctgccagtcacagcttttaacggaagaattgttttgcagcttcgggttgatttccccatccgtgcggataaaataaagcctgccgcgtgacggaaccgctgacgccgcgatcggatacagctgatgggccatatcaggcataagcccgatatgattcgccgaaaaaaagcgtttcgcagtctcgtatgacacatgatctctcgtaaacaggtggagatccttgtgctccgcaaaaagcgccgatgtcttttgcagccgtgtctcatcctgataataaatcgattgcggcaggatgacgatcctgttttccggaaaggatttgacgattttttccctgaacgtctgatagtacggatagagatccccgaaatttccgccaccctgacagacgatgatcgtctttttgtccgcccggcgcccgaatggaaaattgtcgggattccagcgctgtttcacgcggatgccgtgcgctttaaaaaacgcctccgtccctttcataatcaataaatcccctacatttccgtagaggggatagtcggcatatatgatgtcggattgcggcggtataacgctgagcagacccgtcagcgtctcttttaatcggctcataacatggcggctgtccatgttttctcccctttcgtttcaaacagttgcgcaagtgcgtcaatgacacgctgctgctcctcagaagacaggtcagacccggacggcagacaaatccctcggctgaaaaggttctcagagacacgctcatggtcgctgtgaggataaaagacggaagatgagaaaagcggctgcgtgtgcagcggtttccacagcggccgggcctcaatattctgttccgcaagacaggcgacggcttcttccggcgtcacgccgttatcaagcgtcagagccgtcagccagcggtttgaaaccgttccttcaagctccggcatcatgcggatgcccggatatgtttcgagcgcttcccgataccggtgaaagatttctctcctcgcccggacgcgatcttcaagcacttccagctgcgatatccccacgcccgcgagaatgttgctgagcctgtagttgtaaccgagctcgctgtgctggtaatgaacggcggcatctctcgcctgtgacgcaagaaacctcgctttttcaatcgcggcttcatcgtcagacacgagcatgccgcctcccgatgttgtaatgattttgttgccgttaaaggaataaatgccgaaacggccgaacgtgccgctctgcctgcctttatatgttgatcctaaggactcggcagcgtcttcaatcagacagacgccgtatgcgtcacaaaggctcattaattcatccattttcgcgctttggccgtaaagattgacggcgatcaccgctttcgggagtctgccgcgccgctttgcatcccggagcgcccgctcaagcgcagcgggcgacatattccacgtctcccattccgaatcaataaaaacgggctcagcctgctcatacacaatcggattcgccgtggcgacaaacgtaaaggaaggacaaaatacaacgtctccttttttcacacccgcaagccgcagggcaagatggatggcggccgttcccgagcttaaggccgccgcgcttttcactcccgcatattccgcgagccgcgcttcaaacgaattgacgagcggaccgagcggggcaatccaattggttcggaaggcttctgcgatgtattcctgttcttttccgctcatatgaggcggagacaaataaatccgtttgtttgtttgcatgaaatcatcctttttcattatggataggggagatgacgcgggccggaacgccgaccgccgtcacatggccgggaattctgctgatgaccgcagcccccgcgccgataacggaccaagggccgatgtccatctgcggtatgacggacgcgccgattccgatgtgcgttccttccccgactttcactccgccggcaagcgccgcgcgcggtgaaagatggacgtaatctccgattgcattgtcgtgatcggcaaccgcccccgtattgatgatgcaatgggcgccgatgtcagcgcccgcctgaatgacggcgcccgccatcacaaccgttccgtgtccgacggaagccgtttcactgacgatcgccccggggtgaatgagtgaagcataatcggcagcttcaatcccaagcgtttcagcgaactgctttctgacgccgttgcggccgatgcatatcgtgaacacggcctcggggacgagtttccgaagcatgtgcacgtcttccgtccggcccgtatataaaccgttccgagcggtaaaaccgctgaatccgtcgtccaatatgcccgcaagctccatatcggaacgggcctgcacgatttccttcacgacttttccgtgtccgccgtttccgatcagcacgacctttttcacgatgacatatctccgctgcctgtgaagcgctttgccgtcacatggccggcttggtgtatgccttctgacacgagaacttttttcactgttaaaagcagaatctttaagtcgagaagaaaggtgcggttgtcgacgtaccacacgtcgagcttgaatttctcctcccatgaaatcgcgtttctcccattgacctgcgcccagcccgtaatccccggcttcacctcgtgccgccgcgcctgctccgccgtgtaaagcggcagataatccatcagcaaagggcgggggccgaccagactgatatcgcctttgagcacattaaaaagctggggaagctcgtcgatgctcagttttctgatcagccttcccgttttggtcaggcgcagatgatccggaagcagcacaccgttttcatcacgcgcatccgtcatcgttctgagtttatacaacgtaaacggacgcccgttatgccccggtctcgtctgtttgaacaataccggagacccgatggcgcatctgacggctgccatggcgaagagaagaatgacactcgcgccgcacaataacagcgtcgcggccgctatatcaaatacacgtttcaccttcaaatctgaacagctcctttcacttttcggcatttctgtaaagcaagccgcctttcttctttcgtacaaatgaagaaaaaagcgaatgcggcatagcttatgcatacggcaagccccgcggcgatcagaccggcccagccgtcaagcggtgaaaacagccggataccccggcagacggcccaggcaaatacggccgccgccaacgggccgaacatgcctttgtaaaacgcggttttctgaaagccggtaatatgcgaaacatacagcggcgtgaagacggcatttttcaaaatgagggagacagccccggcaatggtgatgccgtacagcccgagatgtgccggtccgctgagaaccacggccaatatgacattcagtccgcctaaacataaagtaacgacggcgggcgttttttgtttattaaaagccgtccatacgtaaaaaagcggcatgacagagagactgaccaccaaatacgcggcgtgaatatataaaagcggcgccgtctgcacaaacgacgggcccagccaaatcgccagaaacggttcggcaagccctcctaataacgcggcgggaagcgcgaggagaagcccgttcatccgcacggccttattggcgtaagacaggagaccttccatatcgccttttgaataataggaagtcaaaaccggcgcaaacagtgaagcaagcgtcccggcaagacttctgagcagaagcgggaattgaataatcgccgcatagacacccgcttcagacggccccagcacaaggttggccgtcatgaggtcaatctgcagaaacagcagcacgccgatctggttgacagaactccaggcaccggccgaaaacagcactttgcttgtctgtaatgataaagttttacggctgaaagaaaaccacggaatcaatttcttaaagaagaaaaaagtcagcacagctgcacagacggctcccgctaatgccgaaagctggatctgccagatcttcggcggcaggcacgtaaacagagcgagcacacacagcaccctgaccagcatttgcacggcctgaatggaacttgtgatataaagcttgttggcaaaaaacggccccgtcgcgaaccccgccataaaaaacgtcagcataaacagcacgctgccgattacgatagacagcctcacatccgttaagagcccggccggtacattcataatcctgtcaataaaaaaagcagtcccggcgagcggcacagcgagtaatagagatatcacgacagacgcggctaaataattgcttacatacgcattggcctcgtccctgttccccctgtgggcggcgacggagaaaaacctcacaacgactgagctcagcgcaacggtaataatagagaaatagttaatgatattctgtgtcagatggacaaacccaaaagcctcaacacctaatgttttcacaataaagggcgtcatccacactgataaaaacaccgatagtaaaaacgccgtcacattggcgccgaaattaatggcaaatttcatgctccttccgcactgcctttctctttcgatttccgttcgaaaaacgcatgcagaagaagaggaaggcgcattttgcacagaccgagcaccacgcgctccccggccagcagctgtttatggcggcacggcgtcctgcgcacggccgtttttaccatgtcatacgttaagattctgccgatatgcgccgtaatctggtgtgacggctgcggggcggcgcatgcgttggcgatcagcatcggaatctgatgcttgcacaaatatgtatcaatatcgctccggcaggcgtccgtcagcccgtttgcctcataaaaagccattttcgctgcatattgcttttgcagttcgtgatctaagcggggcttaaacggtgtttctgtaagactttgcggattttcccggtagatatacagcccttcgtctatcactttgacacgcgcggcttggcggaacgctgccaagttaaacggagagtcctcggcaaaccggatatcttcatggaacaacagcccttgcaatgcttctcgccggtatatatagcgccacacataccaaataaaccgatgttcgtgcgcgcgggtcagcaatgcggtcatttcatccgctgtgaagacgcggcccggcggaagggacggcggcatatacgttctttctttagacggcgtttctttgtaataaccgcagccggcgatatccagccggttcttctccgcttcttcataaagccgctcgaacattgtttccgtcacataatcatcgccgtccgcaaaaccgatataacggccgcgggcggcttttattccggcattgcgggccgagctgaggccgccgttttctttatgaatcacccggattctcgcatcttctgcggcgaattgttcagccatccggcctgactgatccggtgaaccgtcattgacgaaaatgatttcgatgttcctcagcgtctgttttgttaaagaaaccgcgcattctttaataaaaggctctgtcttatacatcggcacgatcacgctcacaagcggcgcggtcattgggcatcaccgctgattttcgagcgcagcccggcaaaataaacacttcgcaaagaaccgccttcctcatgcttgccgctgagcagccgatttacggcggatgttacggcttcagggtcgggacgttcaagcaatgtcatgttcggtatgtttttcagccattgatagccttccatcaccttatgatcaaacgaacgaatgacgacacaaggcgttttcgtcagcgcacaaaaaatcatcccgtgaagcctgtcagtgacgacggcttccgcgcctttcagcgtattccaaagcgcttccagctccttttcgcgtgtatggcggctgaccctccggccgaccgtcgtggtaaaggaatacagctctccgtactctttggccaaagcttcttttaccatcgttctgtcctcagccgtcagcgcgctctccttatcctcccgtaaacagaggtagatcccttcccgcgctatgccccgctcgcttttatccaaatataagaccatgtcaggctgtttgagcactgtttttccgggaaaatgacgcttcatccattgatacgtcgtctcatctctcgccatcaacaaaaggtcgggatgcgcattgtacacttttcgggcgcgcttcagttccttccgtcccttttttgattcagaaaagtgagccgtcgccggaagctgaacgatccgatattgccggaatgtttttatgataaagcggcgcgtccattcctcataccggtacaaatcccccatgttcccgccgccgatgatgaataccatatcatcggggtggcgctttttgatcagcacttttgccgatctgtatatatccttcatatccacctcgacaatgtcaaaatcgggatactcccgttcaagaaacgttttgcttgcgtaggcgatggcgtgatcgccgagattatcgtgggacgggagcagcgtcagaatgatcttttttcttgccgctgtaagccccgccgccccatccgctcccgttccgaaatgaaattgggacgggtatttgaccttaagcaaaagccattccgcgagattgatttttaaagattgtatcgacatgtcttcaccctctgattttcattttgtactcgattgcccgctgatacgcggctgatgccagcgacacgaacggaatcagcttcagcttcgccaaaagcagaaggcatgagcgtttggcgtcaaacggcgccgttcccgttttggaaaggctcatgcggaatacgggatcagcgcatatccggctgatattcttccacttctcagaaaaccggccgccgttattccgcttccattcattcagcaggcagactgttccgtgctgaacgatgaaaaaatccagctcctgccggtattcgtgtaagcagccgttttcacgcaaaaaagcctcgttcagccgatagagaacgagacctgagtcaaacagctttttctgatagctttgcacaatggaagtcaagtgaatccgataatgatagagcggctgatccacgtacgagaccgcacctgcgaaaacatgcgccctgaggctgaaatactgatcctccacgtgctccagctcatcacgaagcggaaagcgcagctgatgatgctcgatcatggatcttttgtacagcttgttccatgaaaagccgctgactcttccttcaaataaatctttcaggtaccgttgtttcgggcggccctcgtacgctgaagcgatcgttgaaacggcggtcttccccgtatccgcaaattcagccgcatattcgcaaatcacgagatcagcctgatcagccttcgctttttcatacatgcgcaggcaataatcaggttcaacccagtcgtccgcatcaataaaagcgataaattcgccgcgcgccgcctcgatgcccttgttgcggaccgcgccgagcccccggttttgctgatgaacgaccctgattctctcatcccgcttctgataggtttcaagaatcgccgggctttgatccgttgacccgtcattaacggccacgatttcgatattggcgagcgactgattgagcaatgaatctaagcatctttctaaataagtttccgtattatacacagcaattaataaactgaccgcgggtgtttccatataaacctccagtgtccattaccgggaaaaaatcgttctgtacggaagcacagacgaatcgaccggcataagcaagtaactgtaaagaaaataacagacaataatggcgatataaatcagcgcatttgatttttcatcaaaaatcctcacaaaataagggatcaggatcatttggtacaggccgaaatatatattaaaccgggcaaaaataacatcctttgtcgccaaaagaccgaagagcaggccgagcagacagaaattcacgatgacatcaatgtcaggccagagcttccgcagccgctcccggtagcagaaagccaaaaacagcggcagcagcagcaccgcgattttcacgacgttcatcccgttcgtattcgtcatcagccatttctcataatggccgtacgagctgttttccagcacgacgacaaacagcgaaatgaacttctgatacagaaacgtcataagaagaaacaatgccgacagtccgaaaatcgcgggcgaccaggctctttttctgacgagaaaataaaccggaatcataatcagcgctgaggaatgaaaaagcgaacacagcagcacgattgacatataacgcttccagcttccgctgatcacgtagcggacggcccaaaacaaaacggccgccaccatatactgcctgatcccgttaaaggaagcgtaatagtgatacgtgcccaaaaacaaaaatacactcagctcaaacggacggccgaactcaacgagcccctttaaaataaagctgcatgtcacgaccgccacggtgaaatacatgatttgcggatctttcgtgataaaattcatgagccagatgagagccgtaaaccccggatcaacggctgcttttttcgctccgaacccgaagatctcccaaatgctgccgtaatttcccgccagcttgtacattagcgcgtacgtctgaaaatccgtcccgactctgtagcgcaaaccggagaccaataccagcgatagcagcggaacgagcatgacgagctgattcggccggtatccggtcgaaagcgattgatcacgcccgccgcacattttcgcgaaccatgaccaaatataaacaattcccatattgactacatatacaatcattcgttactgttcctttttccaattcatattgtaaagcttcataacagcccccgcattttctcccgcgtcatatcccagccgcctgagggtttctttaatacgcgccccgtcaggctttgccgcctctgctgcccgtaaaaccgcggatgcccattgtcccggcggttctttgaggctgagccttttgaccagcccgagcccggcatcggcttcttccgttatgccgtctgatatcacgcacggcaccccggaggcctgcgcttcaacgagcgtgacgggcagcccttcataaagagacggcatgacaaatacatccagcgttttcagcagatcatgaacgcggtcttctatgccgataaaacgcacatcatcatcaagccccagcttcgccgccagattttccatatcggtgcgaagcggaccgtctccggcgagaatcagctgtaagccgatgccccgctctttcatatcagcggccagccggagcagaaattcgtggtttttttcttctgtaaagcggccgatatggccgatcaccaaacggccgtctgcaatgccccgcttccttttttcagcttctgtgtccgcgcacccgccggcaaataagtcgagatcaatgccgttcggcaaaagatgcacgtctttttctttcccgaataagaaacggcccgcctcttttccgcaggcgcacagtgccgtggcgtttgccgtgatcagccgtctgaaaacaaacagctgcatcccggcaagccgcgacgcccgccccgccacgacgtactgtgcgaatggcagatccgcaccgggacgccggctaaacgagcggcaagcgcgataaatcccgactgaaaatcggtatgggcgtgcacggcggcaaacgggcctttttcctgaatcacccgcttgacctgtttaacaaatgtaatcgggtttgtgctgccgatgctcggcacataaaaaagccgtccgccgagagcgagaatttcctcgtcataagcgcacggatcgttcctatgggttaaaaaatcaaactgcaccttcgttctgtccatcttccggtacaaattcatcatcatcgtttctgcgccgcccctgttcatcccgctgaagatgtgcagcacccgcatcggtttgtcagtcatgttcggcaagcccttctttttggcggatgtccctgtttttatgataacggttcatgaccgcgggcggcgtaatggcgcggatgagcggttttgcgatatacgcgtaatgggaaatcggcagcttcagccgtctgcatgcctgaaaaacgagcaccgcattatcaatggaatacgtaaacgatctccttttgaacgcatcactgtcctctcttactttatacagcgtttcctggagattgtaccctcggaaacccgcttcaaaaaagcgcagccacaaatcgatatcctccatccgccgcgtccgcctgactgaccggtagcctccaagcgctttgtacgcttcagcccgcatcataatggtgccgtggcagaacggtgtgcctttcgccataattcccggtttcggcacgggcggcaaaagccgggcgcccctgacgccgaattcatcaaatacgagcatccccgtgcccacgacttgatagtgggcgtgcttgtttaagaaagcggcctgtttttccagtctcctcgggttggagatgtcatcaccgtcctgcctggcgatataatcccccgttgcgtatgtcagacagcggttcagcgaagcggcaagccgttgattcgtcttattttgaatcagcgtgatccggtcgctgtaatgatccgcgtaacggcgcgcaatctgatacgttccgtcagttgacgcgtcatcacacataatcagttcccaattcttatacgattggctcaggatggattcaatactctccgctaaagtctcttcgcaattataaattcccatgataacggaaattttcggttgtgctcctgcattcatacgcttttctcctttttatccatataaccggcgtaaatgtgcgccatttcctttaccgtacgtgtttctgaaaaaaattccgccgtcctgcgcccttcttgtcccattgcttttcgcagacccggggatcggtacagcttttcaatccgatcggcaaatgccgcgctgtcccctgccggcacgagaaaaccgttcacaccgtcttcgatgatctcacggtgccccctgttgtctgcggcaacggcgggcttttcggcagccatcccctcaagcagattcatgccgagcccttcgcggatgcttgaggcgacggacagatcggcaagctgaatcagctcatgaatgtcacggcaaaaaccgtaaaaccgcacaatgtcggataccccgagtgattcagccttttttctgtacggctcttccatcgcgccttctccggcaaatacgagtttcagctccggaatgcggttcttcagcagtgccgcagcctcaatgagaagtccctggtttttattgccgtttaattcagcggggtatatgaggataaattccccggcgccgaagccgtgtttttctctcagacgttcactctctgcccggctcacagggcgaaacctgtctgtattcacgccgatgccgtgtattttcttcgcgccgcaagctgtttttttcatttgcttggcccgttcgtaatcctcttcattaatcgtaatcaaacaatccgtgtaagaagagagaaatttttcgatcgggtaataaagaagccaatttttcaggggcgctccatcgcagaagtgaaagccgtgcgcggtgtacagcacctttgtccctttttggcgcgcttgtctcgccgcaaggcgtgcaagcacgccgccgaccggcgtatgacagtgaatcatgtcgtagccgttagcctgaatgagccgtttcagccgcctgtaaacagaaagattttcgggatgaaacggcgagcgccggatcggaatggaaaacttttcatcaacgaatggaagattcatattgccgcctgccgcgacgtgcacctcccagcccatatcctgaaaccattgaaaatacggaagatgaaaggctttaaaatgataatcgacagtggcgcagaataatacttttttcgtcatctttctgtcctcccatcacacacctgcggccgcttcttcatgtactgattcgatcgcctcaaacagccgttttctcagctcatcttcaggcagacggctgaattcctccataaaacggatgagcacggcccaatccccgtcgatcgctttcccgatatggattttcggaaaaatctgttccgtatgtacttcattatgattcagcagttcttcatacatcttttctcccgggcggatgccggagaattcaataggaatctgttctgtcgtatagcctgataaatgaatcaggttttttgccaagtcgacgattttgacgggttctcccatatccagaacgaaaatctgccgcccttttgcaagcgcccccgcctgaatgacgagtcttgacgcttcggggatcgtcataaaatatcttgtcatcgccggatgcgtgacggtgacgggtccgcctttttcaatctgctttttgaaaatcggaatgacgctgccgcggcttccgagcacattcccgaaacggacggcggcgaatttggtgttgctgacctttccgaggttcatgatgaccatttccgcaaaccgcttcgtcgcgcccatgacattggccggattgaccgctttgtcagaagaaatcagcacgaatgtttccgttccgcacatatcggcggcttcggcgacatttttcgtgccgataatattgtttttgacggcttcttccggattatgttccattaacggcacatgtttatgggcggccgcatgatagacgacgtgcggctcgtattttttcatcaacgtaaagattttatctctgtcctgaatatcggcgatctccgcgtgaaaaagcacctctttgccgaagcgtgcggacagttcgttatgcaccgaataaatgctgttctccccgtggccgagaaggacgatttcatgcggaagaaacgagctgatctggcggcagatttcagaaccgatagagccgccggcgcccgtgaccagaatcgttttccctttgatgctgtcagaaattttgctcgtatcaagggtgaccggctttctgccgaggagatcttcggctttcacatccctgatgtgtccggcagcctgcgttccgagcaggatctcatcaaattgcggcatgattttaatatgggcgcccgtctgcacacattctttgtacagcgtctggagctcatgggtgcaaagagacggaatggcgatgatgatgtggtgaattctcagcctttgcaccgccggcataatgctttcttttccgccgatgacgggcaggcccatgattttgagcttatgcttcgtctgatcatcatcaataaaagccacaggcatgattccgagatcatttttctgcgtaagctgacggacgagcagcgttcctcccgcgcctgcgccgatgatcagcgcccgggaagagtcattttgcttcctgccgatcgtttctttcagcacgcgcgaaatcatccggcttcctccgatgaacaatagctgaaccatccagctgacggctaacagccggaacaaaatcgtgtggaacaccccgtattggacggcggctgtgacagctgcggacagcgtgatccccttcagcagatcaagcagctcgccaattcccgtatacgtccatacctgcttatactggtgaaacataaaagcgcatacatgatggctgatcagcatggtcacggcggtcagcagcaacgctccggagtcataaaagtgataagaatcctcaaaaaattgatatcctataacaacggaaagtaaaacgagatacgtatccaatgcaaaaatcattgaaagtcttctccggtaagtcaatctttcccctcctcatttatcggtttagctgatacggttttcgtaaaaacagacataacagctaagccgataacaatgcatcatcttaagataaattgggcatttaacccgtcctcacaccccgccaccgacgaccagcatctaaggcggcggaaaacgccgcccacagcagagccgagtgcctccgttgataaaggtaaggagacatcacctgcaccgctcaatacgagtagtgctctgtttttttgattttctttttattcagcagcgcccccaaaagctttgcctttgactgctggagcgcgtctttcgccttttggacggtatccattttcgtttttccgctcaagacgacgagaacgcttccatctgtctggttcgctaaaatctggccgtccgccaccgccaaaagcggaggtgaatcgaaaataaccagactgtaccggctgtacatctcctgaatcagctctcccatcgcctttgaagataaaagctcggccggattcggcggcgtcggcccgctcgttaagacgtaaaggttatcaatcagcgttttttgcaccgtttcgccgagggaagcgtttccgactaacacattcgtaaggccttgtacattttcaagctgataggtctcgtgtatcgtcggttttcgtaaatcggcatcgacaagcagcacctttttttcctgctgcgcaaataccgcggcaaggttggcggcgctgaatgactttccttctcccggaacggaggaagtgacgagaatagagcgcaaatgggtctgaacagaggagaactcaatatttgtccgaatggtgcgatattgttcagccaccaatgatttgtgatgtaaaacggatatttgagccagtccccttcttgatttcttttttctgaatcccaaacgcctcactccccgaaatgtttttcatcagaccgtgtctgctgatttttgatgtcatacacaacccctaaaacaggcaagtctgttttttcgctgagctgccgctcgcttttaacggtttcatcaagaaagtggagaaaaaacgcaagcgtcacacccgccatgagagccgcaccgaacgccatcatgatattcctgatgcgcgaaggcttgaccatcgggctttccgatgcttttgcctcggacaaaacaatgacgccttttatattcatcctgtcacggacttcttttttaaatgtcttcatcagcgtgttcgctatagcggcggcctgtttcgggttctcgtcctgcaccgctgcgttaatgatctctgaatcggtttcgctgcttgtcgtgatctttgcttttaaagcggatgccgtctcagaaagatgcagcttctgtttcactttctcaagcacaaccgggcttttcattatcgtttgaaacgtattgttgtaatgaagattcagctgaacgtcgctgagattcgaatttttttcaccgcttgtttcatgaatgagcacttgggtcgatgcctgataaacgggcgaaatcacccggaattggatgtatcccgtcatcagcgttacaactgctgtcatgataaaaatcagtaaaaatctgtgtttaataatgtcaaataactctttaaaactcatattctcattcatgtaattacagcctcatccttattgcatcaggcttaaacgcccccttctgttaatgattggattataaaagaaaaggtcgaaatttgaaaatttcaaattaagccatttagttctttttagagaacattatcatgattttcctcttatttactgcacttcccttataattttaaattttataaagaacgaaaaatttcttataatgaacaaaaaaatgccagtatacaggggagaattcagcacaatgattggaagaataattcgtttataccgcagaagaaaaggctactctattaatcagctagcagttgaagcaggtgtctctaaatcttatttaagcaagatagaacggggggttcactcaaatccgtccatccaatttctgaaaaaagtatccgccaccctgcaggtcgatctgacggagctttttgatgccgaaacgatgctgcatcacatgggaggcacggaagatgagtggcgcatccaccttgtgcaggccgtgcagtcgggcatgccgaaagaagaactgttcacctttacgaacaaactgactgaaaagcgcccggagcccgcatcctaccgtaacagaaaactgactgaatccaacattgaagaatggaaagcgctgatgcaggaagcaaaagaactcggcttgtccgttcaggaagtcagatcatttttagaacggaagcgttactgatgatatgctgatgaaagggcttttattcgcttcatgccttcatctctgtttataatgaaaagaaaaaaggggatgaaatcatgacaaaacttaccgttcaaacccgctgcggcgcactgaaaggaactgccggccgcggtgcccgcacatggaagggcataccgtacgcgaagccgcccgtcggagagctgagatttaaagcgccggagccgcccgcaccttgggacggcataaaacatgccgattcgttcgggccgatttgtccgcagccggatgatatgctgtccatatcgttttccggagatataccgcctcaatctgaagattgcctttacctcaacgttttcgcccccgattcagagggcgaaaaaaagcctgtcatggtatggatacacggcggggcattttatttaggtgccggaagcgaaccgctttacgacggatctgcccttgccgctgacggagatgtcattgtcgtgacactcaattacaggctcggaccgttaggctttttacatttgtcttctattcatgacgcgtattccgccaatatcgggctgctcgatcagatcgccgcgctgcgctgggtgagggacaatatctccgaatttggaggagacccggataacgtcacgatatttggtgaatcggcaggcggcatgagcatcgctgcgcttatggcaatgcctgacgcaaaaggcctgtttcataaagccattttagaaagcggcgcctctcatacgatgccggcggatatggcaaaagacatcgcggcggcatttattcatgaagccggcactgatcaattgcaggagctttccgttaatgacctgcttaagactgcggataaagtgcggcgctcactggatcaaaacatttttcagcttttgtttcagcccgccatcgatccggccacattgcctgcggaaccggtgaaagccatagcagacggggccgcagaaggcatacctatgatcatcggaaccaatcgtgatgaagcatatttgtttttcacccctgatacagacattcactccgagaaaaagcagcaagattatttgcattatcacctcggagaaaactgcaccgagcaagcggcagatttatatccgcattcattaaagggacaaatcgatatgatgacggatctgattttctggcggccggctgtcgctttcgcacaaggacagtcgcaacacgcaccggtctggatgtaccgctttgattggcatggcgaaacaccgccgtttcataaagccgttcacgctctggaattgccgtttgtgttcggaaactttgattctttgagaaagacgctgcaagagccgctcggtgatgacgcagaacagctttccaaacaaattcaatccgcatggctcgcttttgcaaaaaccggaaacccgaacacctctcacttcaattggcctgaatatgaaaccgattcacgcgaaactttgcttttcaacacggataccgctgtcgaaagtgatcccgattcagcaaaacgccgcatcctgtttcaagcataaaaaacgccaagggagccggctcccttggcgtttcattttcatcttacagacatcagtcagcttcgcagcatatccatttccgcattacccctgatatgttatattccaacccaatacgttaaccaaacattcataaaggagtttctatatggagaaatcaagtattatcggcacagctgccgttataatcggggcgcttattatcttagtttcatttatcttcctgcgcgacactgatttctatgccgtgaggtggataggggttgttatcatggttgcaggattttcatgcggtccggcccacaccatttcaaaacataaaaacaaacatgaaaaagaaacccggtaacctttactgggtttcgttcatacatttcattttatctcacttcataatgcaactccgcaaattgtttgtaacgcctgacatcagtcagcttcagtcctgtctcccggtctccgggtttaaacaaagaaattccgcggccgagcagaacgggggcgatctgaatgataaactcatcgacaagtttttcctccaaaaccgggtgcagcagatcactcccgccgacaatccaaatccgcttgccttcttggcgtttcaatgcatttataaaatcggcaggctcttcatgaataaaccgcacatgttcagtacgcccggtcaatgtccgcgaaaacacatagcattctttacctttgtacggaaattcctcaggcaataaaaccaatatttcctcgtatgtttttctgcccataatgatcgtatcgacagattcatagaaagcttcataatcggtgctgtcttcaccttcagttccgattaaccaatctaaagaatgattttcccgcgcaagatagccatctgcgctgacagctccgtaaaaaacgagctttctttgaccgctcataaaaatccctcccccttttttattataccttaaacatgcgggtgaaatgaaaaatgatagaatcgggtaaaaaccgccgttaccgggttttcgttttttcctgctttggagatgctgttaatatgccgtctatccatcttccggtaatcggcataaagaaatgaaggaagatcccgcctaaacaaacggttaataacgttccgatgcctaccggaccttttagcatcaaggccagtatgaaaaatatgaagtaaatgaccgttcttgaaaaaaagatgcttctcccggttaaatcacggacaattagcgttaaccgatcaaccgggatcggtgcgaaatttgtgtgcagataggttgcggttcctatccctatcacaactaaaccgattgcaaaacagcccgcctttccgtaccatagttcaggcgttatgactcgatgcagaaaaaaaagccacatatcaatcccgattcccgttatgaacgccgtaatcatccctgaaaattccggtctttgcctttttaacattgaattacagcaaattaacaggaaagcgatgatgatttcccagcttcccacggtaagccctgcatggacggacaatcccacaataagcgcatcaaaaggcgatgttccaagatctgattgaatcgtgacagaaataccaaaggtcaagatcatgattcctaaaacataaaaaacatatttcactttatcgtcctcattttcttattttatgttgcaaatacaacaaaattacggtatgtttactatacggtattttcattgcaaatacaacaaaattcagctggtatgataaatgaagaaaggagctgtatgaccctgagtattaaattaaaaaagtgcagccttaacgatataacagagctccgggagataagcattgaaacattcaatgatacatttaaagatcaaaattcacctgaaaatatgaaagcttatttggaaaatgcattccgctctgaacagctgaaaaaggaattatccaatccgtcttctcaattctattttgtttattatcatcatgaccttgcggggtatgtaaaagtcaacatgaacgaagcacagtcagaaaaaatgggggaagattctcttgagattgagagaatttatataagaaaaagccatcagaaacacgggcttggcaaatatctgctgaatgaagctgtgaaaatcgcaacagcacacaataaaaagaacatctggctgggcgtatgggaaaaaaacgaaaatgcaatcgccttttatcaaaaaatggggtttgtccaaaccggagaacactctttttatatgggggatgataaacaagtcgactttatcatgaccaaaaccctctcgtaaaaggatacaaaaaacccggccaagctgccgggttttttctcttattttaattttcccgcacggatatcatcggtcattccttcgtatggcgcttctgaaatcaatgtttcgttattgattcccgcattgttaagatacgtaatatccgcaaactcgggaacgacatatttcgggtacgtttcatatttctcacgtgactctttcatcacgtcaatgtaatcattttggtagcacaccgtgatttccggatgctcatgcacccatttcgggaagaaaataattccgtgcatccgtttttcattcggcataaagtttaaggaaacgtctgtgcctgtcggttcagtccatgacactttgtatacgccttctgtcagcttgacgatattcacttcctggtcgcgcacccaacggccgcctaccattccgctatgaatccgatagtcgatcgtatgatcatttttaatatagatttcatactcccagccgttttcatacgtgtaaatcatatggcttccgataaagttttccatgttgactcactctccatcttattattgaatttcataaatatctaaccgaatgtcatccggcaatctgaccgcagccccgataaacagccggtcctgcagatgctgatatgcctcattgcttgtttcaaacacaggcacagtgcggaaatacacgtgctcgggatcaatgatgcgtttcactgactcataaatgacttttttaaagaaggttcattcaaggacgtatcacctcccgagacaatatgtttgtttaaacatgtaactatttacatgattaattgtaacgctgttaaaatggactgtcaaataatgagctgtttccggttatgttttacagtgttcaataaaaaagacaagggcggcacatgccgaaacccttgtctttttcattaagctcatctataaaaaaacgcagacgagcgtcttcttagtaatcacaatctttatctctgcattctttctttctcacagcatctatagtgtgtcccataatcttgtcatttgctttatcataaataccgtcaaatttatttgatgtatcatcgttgtaatagccaaatacctctatcccgcccattggatctgtttcatatttatctttaaatgtaacgttatgtatgccttcataattcgctttgataaatttctccattcgttcttgagcaatctttatctcttcagcctgaacatttttatcattcatactcttcattataaaacctccggctgctattaagataatgaagataataatatattttttcacagaatcatccgtcccatcagttatgatgaagctcgcggaatggaaaaatggtggtgacatccgatgcatttagggtcttaagatttttctttaatgtccgcagaggatcatataagcggcaatccagagtacttctttattccagcgtctttttagtattcacattctttttcctgacattcgggtttctcttctgcatcgactgacgaaactcctatttcatcattcgttttgtcataaagtccgaaaaattctttttccttattaccattcaagtaccccttcaaggaaataccacccataggatttattttataattgttaatgtatgtaatccgctttatatttttgtaattagcttttatataactttccattttatttttcgcttggataaaaagttcttgttctgcttctttttaatcatggtggtacttcatgtagatacttcctgacgctatagttatcacaaatattagggcaattttgcatctcttcacaaactcatcctttcttagattaaatttatatcaacctcggggtgttgtacatgtctaaaaaacatcaacgtatcaagtatcagtgatcgagaatacttttttataagcgttagttatagttagatctaggttaaatgaagtgatgaaggagaaaggaattcaaatccagaaggaattggctgatttagttggttctactgaggctgcgataagcagatttaaaacaaatacaagatatgatatcacaacactattcattattaactgaggattaaatgtacctatggaagatttgttttatgtcgaggagatagagtaagagcaataaaacaaaattagctcagctcgattgagctggctaatttatcttgtacaaagcttatctttacattcttctttgggttcggcatcaaccgtatatgataatatttctttattgcctggatcatatagaccttcaaactctttttttccattcgtataacccttaatactaataccacccattggattaatatggtaatcatcggaaaaatggatattatccacatttttatagttcattgttaaaaacttttccatatgattctgggcttcttcgaataacgcaatctctttttccttctgatcatactgatgcttcataaaaagtcccccaactgctataattattaaaataaggataattatgtactttttctttttcatttggaaatcaaacccttcctataaataactgtcgttcttaagtaaacgaaatgagcgaaaacttgatatgaatatactttcagcatgtcaaaagcaaagctaaccaattcagaattcatcgcgattgttgctgacaagttaagattggaacttaaagcgagtaaaatgctgatctgacgttttcctgtcgttgagttgtcatgatatttgtacgcgtttaccgttaatatcggggatacctcgacaaatgagacggtagaggcgattgatctcaggaataggtttgaactgtatgagaaacatatcacgaattttgtaagataattaaacaaaataaatacccactcatcctgaggtgggtattttacctttcttcggcattgaccactgaaatacctatctccttgttcgttggatcatatataccggaaaattctttttctttattattatttatgtagcctgaaacttcaactccgcctgtcggatcgatattgtagtcttttgaaaagtgaacttcctgtacatttttatagtctttttttaagtaattcctcatatgatcttgcgcctcaatcacaagtttttcttcgtttttatgtttatcatattgatgcttcacgaaaaaacctcccactgctataattataacaattaggataataatgtattttctcatgcgtatcatcctttcggaactattttacaatataagaaaggtgatgtatatatgccaaaaggaaaagaaataaccgtctctgatgtcacagataaagaatattaccgtttgagtcaagcagcttacaattataaaatgttagccctgcatatgaaatataaaactccttataaaataagtaagacgtcatattggtacgttgagaaagtgaagcaggattctgatacgggtcttgatgcctttgtattctcaaaaggcatcaagtccaaaaacggaaaatggataaaatcaaaaaaccccgaaaacgtggtcgtcgcttttgcgggaaccgatatcggaaaagacccgatcaatgacggcgtaaaagcggacggcggcaatattgttttcggtaatgatccgcaaaaagaagtgtattatattgtaaaaaaagacgcggaggatacctcgaaaacactcggaaaatataatggaacgccctctcaagacgccatgctcacaaccggaaagtataagctgataacgaaaacatcgcaaatcgatcaagccgatcagctggtacgcagcgtaaagaaaaagtatgccggaacatcaacgattatttcaacaaccggccattcactcggcggcgctgaggccgaatacagcgcggtgaataatgatgtgtacgccgtcgcgtttaacagcccttccgtcgtgaaactgcacgatgaggaaacacagaaagacatcaacagcggcatatacgatccttacatccggtcaattatcaatccggacgacatggtcggggcgggttattggaacgaatatgaccgccacaacgggacaacgatttatacgaaaaacccctcactctcacagttcagccggaagcagcggcttgatgggaacttgaacgagcagatcggcaaaaatctcgcttatttctttactaccgtcattctgagaaatccggatacacacggcttaaatgaagcgaatttcatatttgaccgaaacggaaacatcacaaatccgaacggagatgagttagtcttcgataaaaatctcggcgctcttctgccggccggtgcgatcggaagcggagacgcgataaaagtaacgccgaaaaacgcaaagaagctggctgaaaaggtgcaggccatgactgaggatttgcggacgatgaaaaaagaagcgcagaacgcctatcaggagcacgatgaaaaaatcgccgagctgaaaacggaattttacggccaagtcggacacggcttgtttgatcagcttcaagcacaggacgtgaccaatacaattgaagatattgcgcaatcctacgataaaggaccgattttttacgacacacaggctgagcaggcgtttattgattctttgcaggcggcgatcacggaccttgaagagatcggcggattcttacataaaatagcggacgaatttcaggaaaaagaccagatgctcgcaaactggttaagatgatagaggtggatacataatgccgacattagacgaacttttagaacacaaggacgacccgatgaagaaaaggctgcagcggcagatgctgaaaaccgccatgacgcaggcagcggggacaaaactggaaacagtgcgccaaacgctgaaaccgacattcgaaatggacacattgaaagatgaattatatgaagtgtattcagcactattgaacagctttgaaggcaaggcgcaaaaagctcttgcgcagcggatcagtgaaagtgcgcggctgattgccggcaccgaacataacagagacacattcattaacagtttcaaaacaagataaaataaaaacctcgcagatttatcatctgcgaggtttttcctatcgtcttaactgagacgcgctcggagggattcgaacccccgacagacgtggtaccggaaaccaccgctctatccaactgagctacgagcgcacgttttttcaatcagatacctttatattataataaagaaacgcacagaaagcaactcttttttgattatacacaacaggattatgctgcacgaggacgctgcataatcctgcatcgtttaacggcattgattttcacaaaaaatgtatttcaggcggactgccctcggctcggtacatttccagccgcttcagaaaaagcgataatcacccgtttcagctttttttccaaatgtcctttaacgtccaataggtgaattcctcaacctttacggcgcctttctcagaaaacagctcaatccccaatctgccttcattcggatagatacggcttgtcatcgttgtttctccatgattggcgaatacttcaatcgaggatctgtcaataaagatacgcagcgccagcttgccgtttgcatccagccgcacccttctcacaccgtctttccccatcttggtgcaatcaagtgtcagctttttatccgttagattgtatgtcagcacaagttcttcttcgtcaaggccgcgaatcttaaaacctgccgtttcggcatcagaatcgtttacatcaaacacggctcggacttcaagcaggtcttcgggcgtctttgccaagtaactccctgaaaccgatcgtccggcacattcccgatattccattttccgcagctgcttggtttcttccacgggattcatcaaaagtttatgatcatcacgcaaagtcagttcccgcggcaaagtcagtgcaccgcaccatccgtccgcttttgtcggcatctcagattcccacatatccatccagccgatggcaattctgcgtcctttatcatctaataatgtttgcacggcgtaaaagtcatggccgtgatccagttctttaaaagcgccgtgtgtaaatttgtttgtttcattattatagtcaccgattaaatagccggtttgatgtaaattgttatatgaatcgccgtccgcctcgataccctggggcgaaatcagcaggacatgtttgccgcctaattcaaagaaatcaggacattcccacatataaccgagattaccgtcactttgggcgagaacccccgcgtattcccaatcacgcaaatcaggtgaacggtataaaacgacccgtccgacgttttcttttgaagagttgccgatgaccatataccaaacatcgcgatgcttccatactttcggatcgcggaaatgacgggcgctgtcttccggcggttccgtaataacagggttttcctgaagcttttcaaacacggttccatcttggctgacagcgatattttgagtctgatagaataggtctttctcttgatcaattatattatgtcctgtatagataagggctaatcttccatgatcatcgaccgcgcttcccgaaaaacagccgctttgatcgaattcgtcccccggagctaaggcaaccggcaggtgctcccaatgaatgagatctttactttttacatgtccccaatgcatcggcccccaatgctcatcatacggatgatgctgaaaaaagacgtggtattctcctttaaactgaataagcccgttcggatcattgatccaattcgcccgcggcataatatgataccccaatcgatatctttgtttcactttaccctcggcttccttcaaagcttcttccgcctgctgaattctgtccatttgtaacatcctctctatccgattttttgcagacgctggacacgcctgctgttttgtttcgggcccaataaagtaaatatggagatgacggtaaaaccaaagacgacgaatcccatgatgagataggtttgacggaaccccgcactgtcatataatcctcccgcaagcggcgacagaatcgacgcgcctgcctgagatgcgaattgaaaaccgacgagataaaggacggacgacagacgcgtatcaaaattggcggccaaatatttaaaaacggcgatcagcataatcggcaattccagtgcgtggatgagtttcattgatgaaatgcctacaggctcaactgcaattccggacccgacgatgcggaaagccattaaaaaccccgctaaaatcaaactgtttttcgctccgaacttattgacgataaaaggcgcaagaaacatcatgccggcctccaaaaacacctggaatgaattcagatagccgaatacttggttacccatcgacactgaaggaaacaaagacgcatagtagatcgggaactgctgatcataaacgccgtaaatgcaagtcaccccgataatgtacatcataaaaaaccagaaatcttttaataaaaagagccgccccacatcttttaaccggaccgattccgctctgtttttctcatgatcggtcatttctattttcacggacatgataatggccgttaatatgacggctgaaacagacgcgatccagaagttgatattgggattgatattgaaaagctgccctgcaaaaaatgcagccgccgcccagcccagcgagccccacattcttgattttccatactcgaaatcatacttacggctgaccttttcaatgtacgtttcaatcgcgcctattcccgccaaaaaagcggctcccaaatataagcctccgacaacggcgccaagaaagacgttgtattgtaaaagcggcccatagacgtagatataaaacggacccgtgaatatgagaagacagctgatcataaacaatatctttttcttcagccccaatttgtcagagataaaaccgtaaagaggctgcatgcacagggcaaatacggcgtttacagaaaagataatgcctgtcgctgatccgtttaaattgatttcctgccctaaccaaatcgcaaataaagaatagctggaagaccaagtaaaaaagaaaaagaagaaataagcactcagtttccaatacagactttttgagcttttcatttgcaccgctcctttaataggaccttttaatagtcattttgagccgcatacttccttcttcatattcatcacatacatgcgagctccgagtaagcgcttactttccgccgctgcttgattctttcactttattgccgccagccatctctccatacccgtcacttcccttcactccgtaaataaagcgctttcaaaaagaattgtatgtcaaccggtttcatatgtcaatcggttgacatatgattttctgattattccaatcaaacaaaacgcaccctctttatatgaaaacagaaacatggaatgtccttgcacatgtcagcctgattctctaaaataagtgcgtgacggaaattgtaagccatttcagtatgcaggagggcacgggaatgaagcctaacattcatgatgttgcgaaaatagcgggagtttcatctacaaccgtttcgcgggtattaaataaccgcggctatatcagcgaaaaaacaaaagaaaaagtgtacaaggcgatggaagaaatcaattactttccaaacgatctggcccgctctttattccgaaaacgaaccaatttaataggacttatcatcccaaactccagcaacccgtttttcggcgaactcgcctttcatattgaaagcatttgtacgtccatgggctacaaactgctgctttgcaacagtttacatcgaaaggataaggaagaaaaatatttggagatgctgataagaaaccaagtggacggcgtgatcgccgtgacttataaccggggaattctcaattatcacaagcagaatctgccgattgtcgccattgatcattacttatcggacacgattcccgtcgtcggctcagacaactatgacggcggaaaaaaggcggctgaactgctgattgaaaaagggtgccggcacatcgtccatctcaacggcccgattgaactcgaaacaccggcaaacctcagaagaaaagcatacgaagacgtcatgcatgaacacggacggaagcctattacatatgaagtacccttttatcagcattaccatgatattatttcaacattattcgatgaacagcctgacaccgacggaatttttgccagcgatgatatcatggcggctgccgtgatgaccgaggctaaaaaacgggggaaagacctcccgaatcaattaaaagtgatcggttatgacggcactgaaaccgttcaatcggttctgccggacttgacaaccatccagcagccgatcgaattgatttccaaaacagccatcgagattttagcaaaagaaattgaaggcgaatttgatgatttgccgctggaaacgtatttgccggtacggcttttggaaggacggacaacgtagtcagaccgttcagccgtatgtaccgacgcgactgcggtctattttgagcgctccggccatatcattttctcaaggctccggcgctgatcatcctcattttcactttgctgtttgaactttttgttttatgggaaaaatggtgttagaagaaaaggttggcattttggtcagcgttttgtttgacctttattgaccaaaaatgtatcatgtaaatacatacttacctaaaaggtgaaggaggagcattatgaatttaatacctacagtcattgaacaaacgaaccgcggagaaagagcttatgacatttactcccgtcttttgaaggaccgtattatcatgcttggatctgcgattgatgacaacgttgcgaactccatcgtgtcacagcttttattccttgaagcggaagaccctgaaaaagatatttccatttacattaacagccctggcggatcaatcactgccggtatggcaatctatgatacaatgcagttcattaaaccgaaagtatccacgatctgcatcggtatggccgcttctatgggagcatttttacttgcagccggagaaaaaggcaaacgttacgcgcttcctaacagtgaagttatgattcaccagccgcttggcggagcgcaaggacaggcgacagaaattgaaatcgccgcaaaacgcattctcttgcttcgcgacaaattaaacaaagtgcttgctgaacgtaccggccagccgcttgaagtcattgagcgcgatacagaccgcgacaacttcaaatcagctgatgaagctttagaatacggcttaatcgataaagtgctgacacgcaatacggaagaccagaagtaatgcccaaaaaacctgcaagagatgatgtctcttgcaggtttttttatgctttattcccattcaaaaaagtaatgaatgctttgacgacagataattctaacgctgaagaatcatacatgagccaagtatcgcgtatcacaggttcattatttttataggatagcgccaatgtgtataattcatcagaaggctgaagacagatttccggcacaacagaataaccgaggccgtttttcaccatctctttacaggtttcctgcctgtctacctccattgcaatgaaaggcggttcagtaaattggttattccaccatttttgaatcaaacttttcaaagaagcatcagtttgataataaatcatcggcaatttgggaaggtcctcactgttgatttcagtttttgaaataaggtacagcctctcttcattcagcagttgtttttctccttgccaatcataattccccctcataatcccaaggtgtacccccgaatgatgaagcagatccatcaccttcgcactccatcccgtattgacgtggaattgaacagacggatactgatcagaaaaccgttttagaatcgccgggagcttatactgagcaaaattgcttgagactcctaatctgagaaccccgctgacttcatggctcatattgagcatatcatccttcactcttctgaactcctgcagcatctctttcgaataatcaaccagatgttcaccttctgaagtgaactccatccctttttttcttttataaaaaaggcgcactccgaattgtgcttccaggtttttgagccgataacttaacgccggctgtgtcatatataatcgctctgccgccttcgtcatatttttttcttcgaataatgtaatgagcacaatccaatccttttcatccatatgaaatcccccaaaatatttttctgctataaaattttctcctattataaaagttttttatttaactttataaaaattatatgttttacttataatccttatttatcatacgatatcttccaaagggaccggtacctttttatccacacaaaatgatgtaaggatgagacagcatggaaaaagttcctgtaaccgttatgagaggcggcaccagcaaaggcgtttttattcttcaaaaagacatgccagacgatacaaacctatggagcgattttcttttagacattatggggagccctgacgagagacaaattgacggtctcggcggcggccattctctcacaagcaaggcagccattattaagaaatccgccagaaaggatgcagatgttgagtatacgtttgctcaggtcagtctgactgacaaatttaccgacttcaaaggcaattgcggaaatatctcttctgccgtaggcccttatgctattgagaaagggctcgttcaagctgaagagccggttacaaaagtcagaattttaaatacaaacactcaaaaagtgatcgcagcagaagtcgaagtcagaaatggaacatttcattaccaggggactgctctattccgggggttccaggtacagcttctcctatttatctttcatttcaccaggctgaaggagcggtgaccggtaagctgtttcccaccggtcagcctattgatgttctcgataccccgtatggaaatatctcggtatcgattattgattacgccaatccgcttgtctttgtaaaagcagaggacacggggcttaccggcttagaacttccggatgaatataccccggatatattggaaaagctcgaaatgatccgatcgattgcagccgagaaatgcagattcgctccgagacatgaggctgctgcaaaatcaccggccgtaccaaaactgacattaatctcatctccagcggattatatcgatacaaaagggataaagagacacgcagaagagatggatcttgtcattcgtatgatgtccatgcaaaaaccgcatcaagctttagccattacaggggcggtatgtacgactgccggcatgctattgcaagatacaatattatctgaattttcattctccgggagaacgatccgattggggcatccaagcggtattttaaaaaccgaggcagatgttgatccggatggaacaacgattaaagtagtacgcacagcaagaaaaatctctgaaggctatgtgtttactaaacaaagttacagcatgaatacgctcaatcacattggttaataccgtcttcagacaagtcaaagataaacggaggaatacgagatgatcaatgtaaatgcgtctaatcgattaaacagactgcctttttcaagggcccatcaagcagtgctcgttatcctttcattcgcttacttttttgattttatcgatttaaatacgttttcatatgcggcgccttcacttttaaaggaatggaacatatccactcatactatcgcttttattacatctgtctcctatttcggaatgtttatcggcgcctctgccggaggatggttttcagaccgtttcggaaggaaaaaaggtttaattctggttgtcacctttttctcttccttctccctcctctcttctctggcttggaacccagaaatactcggtgtttttagattttttacgagtttaggtatcggcgccacaacgattgtggcgagtacgtatatcagcgaatttttcccatccgcaactaaaggcaaataccaggcaatctgtattacaatcggcatatgcggaattcctgcggccggctgggtggctaaattggtcgtgccgtccgcctcttacggctggcggtttgtctttctattcggcgcggtcggtattttttttccgctgatcgccagaaaactggaagaatcaccgaaatggctggacacgaaaggaaaaagcgaacaagcacaccgcattctgcttgaactggaggcaaaagcagaaaatgaaaagggtgaactgcctgaaccagctccggctctgcaaagcagacaaaccgctgtaaaatccgttccatatcggacgctgtttcaaaagcctttagcaggaagaacttttgttttaatgacgatgtgggcagcttccaccattgcaattcaaggctttggcacgtgggttcccacccttctggtgaaagaaggcgtatcaatggatgagtctatcgtatacgtcactctgggaacgatcggtgccccgctgggcgctctcattgcggcgcaaatctctgaccgtgtggatcgaaagtgggccatttctgttttatcgttaattattatggcgcttggattcttttacggcatcaatcctttgccgatggtcattatcgtatgcggatttctcatgcatatgtttgagcgtactttcagttcgatcgcatatgcttatacgccggaattatatccggttgaagccagggcatctggaaatggcctcacttacggcgtaggacgccttgcaaatgtagccggtccctttgtcgtcagtttcctgtattcaggctacggatttttaagtgttttcttattctttacaggctgctggtttctttgtgcactgacagtcggtatatttggaatcggttcaaaaaaacaaaagatgcagcaggatgatttcatatcggaagaaactttcgtgcaacaaaagttgtaaacgcatacagtctggaaaccgcaaaacatccatctcctctgaggaaatggatgttcttctttcaaccccaacagcagtctcattcgcctcttattctcagacatatctcttattacgaagaaaggcgtggtacgcatgagaaggagaaaagaactttccgtcagaatgaattagatgcagccgccgaaacatatttcagaccgctgccttacaattcacgccatttcttatctaaaatcgggtatgtataccgattcatctgctcaatcagctcatccggccgggaggaactatgtatcagctttaaatgagactcattcgaaaatccttcctggatgctgtacttgaccatcttcatcatcggctcaaaatacccgttcacattgtacagtccgatcggtttttgatgaatgccgatttgcgcccagcacagcacttcaaataactcttcatatgttccgaaaccgccgggcatggcaatgtacccgtcggcaagttcactcattttcgctttccgctcatgcatgccgctgacttcaatcagctccgtcagattctgatgaacaatctctccgctgaaaagcccgctcggcatgacgccgacagcttttccgccgcctgccattaacgcatcagcgacggttcccatcagaccgacccgtgaaccgccgtaaacaaggccgattccctgctccgccatatattcacccagttcggccgctttgcgtttgtactcttcatttacccccgggtttgaccccgcaaatacacaaatggttttcattttttcatctccgcatctatatatgtacatcaataaatcaaaatacactatatattgtcccatctctatatgataatatcaataagaatcatacaggacataaggagtgtttcacatgcagatggctgaagcagaacaatggacgaaagatttttacgaaaaacgaggatggacggcgtacgggccatttatcagaatcggctttttaatggaagaagcgggtgagctcgcccgggcggtaagagcatatgaaatcggcagagaccggccggatgaaaaggacgcaacccaggctgaacgcaggcaggagctgattgaagaaatgggtgacgtcctcggaaatctggctatccttgccgataagtacggaatcacgttagaagatgcgatgaaagcccatcaggaaaaactgatcaagcgctttgaaaccgaataaaaacacggcccgtccgctttttcatggacaggccgtatctgaatttatcccgttatctcgtcctgatgctcaaagaaatgctgtttcccgattttatgaaacagccccgtcttccggatcagctctctcggctgtgattgcaatccgacgatcatcaatctcccgttatgccgtttgatccggttcatcacattccccagcaccgcttctgcggaggtatccatgtaatgcacattattcatcagcagaataagcgtcttcggcttttcctgaagcctctccagcagcgatgattccagtgaatcaattgaaccgaaaaacagcggcccttcaatggaatatgtgctgacggacgaatcatttttaaccgatttgaccgcggcatgcggtgttttaatgcttgttgattcgctcatttttctgataaagaaaacaaaagcgagcacaagaccggcagaaacgccgataattaaatcaaacagaaccgtcagcaaaaaggttgccgccagtacgaatgaatcagtgtttttcagccgcatcatattggcgacttccctccgctcactcatgttccaagccacaaccatcaataccggcgccatgcttgccagcggtacgtgaacggcaagcggggcgaagacgagcaggacgaggaggacggtgactccgtggacaacaccggaaatcggagaaactgcgccgtttttaatatttgttgcggtccgcgcaatcgctcccgttgccggtatgccgccgaaaagcggcgctgccatattggcgatgccctgcccgacaagctccctattgctgtcatgccgtgatcctttcatattgtccgcgaccatcgccgataatatggattcaagtccgccgagaagcgcaatgatcagagccgagggaaacatcatcaccatgttatcaattgagaaatccggaagctggaaagccggaagctgccgcggaatttctccgtaagcagaaccgattgtcgccattttgtcaggaaaaaacacgaccgcagcggctgtagagacaagcagggccacaagcgcgccgggaatcttcggcatcagcctggctgataacagcaaaatggccaaagcaattcccgcgatgaggatgctgtacaaattaaaggttccgatcttcttgcctatttccgcaatgttgaggataaagctttcatgcttttggatatcgcgcagaccgagaaaatgggcaatctgctccgagaaaatcagcaccgcgatcccggccgtaaatccgacgatcaccggcttcggcacgaatttcataatctttccgagcttaaatacgccaaacaggacgagcatgacgcctgccataaaaccggctacaagtaaattctcaaaaccatactgcatcacaatggcaaataaaatgggaacaaacgcccctgtaggcccgccgatctgatatttagagccgcccaacagcgaaatcagaattccggccacaataacggtgtaaagcccgtattccggaccgacccccgaggcgatggcaaaggccatccccagtggaatcgctacaattccgaccacaattcccgcgattaggtctttctgaaatttctgcaaattgtatccctgatatctgccggtaaattgcatcgtcagctgcatcctcctttgactgtttcataaccgtcaacgactacatccagcgtccccgttcccggatcgatcaccagcccgtgcaccggcacctcttcaggcaagagcggatgatgcctgaccatattcacgctgtgggccacgctttcttcgacgctgtgaaaaccggtcagccatgtttccaaatcgactcccgcatgctgcagaaggctgagacatttgtcctccaccccgcgctcttttgctttatttaatatggaagccgcatttaatcccgacattccgcactcgcggtgacctatgatgcagacttcctctgcctgcagttcataaacggcaaccaaaatgctccgcatgacacttccaaatgggtgagaaacaatggctcccgcgttttttatgattttggcatcgccgtttctgagtcccatcgcctgcggcagaagctccgtcagccttgtatccatacaggatacgatgacaagcttttttttcgggaattttgtcgtttggtaaggttcatatttcctttcttggacaaactgctggttgtgctccaaaatgcttgataaagaaaccatttttctattcatctcccatccgattgtattgcaagccttcttacccagcttacagtaaggaattatagcacagaaaaaggcctcaaaagcgctttcaaaaaaagacacgataatttgactgtaaattcagattatattcatttatatctttcaaaaataataaaatttatctttacaccaacctataaagcttttgaaaacagcggttccgctcattttgccttcagaaatataggcggattctgttattgtttggagaaatcaagcatgtacattcctttttctttcattttaagttcaaaagaaccagaaatttatcgtaatgcgtttgattatttctcacgttaccgcttctcttatataataaaatagagaagaaagacaaaggaggagaagcccgttgaaaccctatgtattcatcgcgaaaccgataccgcccgaagtcgaacaaatgatagacgagcattgccgctatgacatctggaaagaagataccattccaaaagagaaactgtacgaaaaaatgaaagatgctgaagggctgctgacatccggaacggcgattgacagtgatttgctggatcacgcgccgaagctgaaggtcgtcagcaataattcagtcggctatgataattttaatattaaagaaatgaaaaggcgcggggttgtcggcacgcatacaccgtacaccttagatgacactgtcgctgatctggctttttcattaattctgtcttccgccagacgggttgccgaattggatcgattcgtccgcgccggcaaatggggaaccgttgaggaggaatctcttttcggtatggatgtccaccatcagacattaggaattatcggcatgggcagaatcggtgaacaagctgccaaacgggcaaaattcggcttcgatatggacgtgctgtattataaccgcagcagaaaaccggatgccgagaaggaactcggggttacatataccgacttagatacactgctgaaaacatcagactttgtgcttttaattaccccgcttactgacgaaacatatcatatgatgggagagagggaatttaaattgatgaaagatacggcatgtttcgtcaatatttcccggggaaagacagttgatgagaaagcgctcatccgcgcattgcaagagggctggataaaaggcgccggtttagatgtgtttgaaaaagagccgatcgccgaagataatccgctcctgcagctggaaaacgtcacattgcttccgcatatcgggtcagcaaccgcaaaaatccgcttgaatatgttcaagcaagccgcacagaacatgattgacgccgtatacggaaaaacaccgaaaaacctcacgaaggaatttcaatgagatgaaaaatcccggccgtttcagccggggtttatttttcgctagatcaaaagtactattttaaaattctttctattcctttctcttgatgctgatacaatgaaaaggaatcagcttcacatgataaaaatgggaggtattgctttgaaaaaacgattatcgtggatttccgtttgtttgctggtgctgttctccgcggcggggatgctgttttcaacggctgccaagacggatacatcttctcacaaggcgcacactgaagcacaggttatcaacacgtttgacggggttgcggattatcttcagacctatcacaagcttcctgataactacattacaaaatcagaagcacaggccctcggctgggtggcatcaaaggggaatctggcggacgtcgccccggggaaaagcatcggcggggacatcttctcaaacagggaaggcaaactccctgtaaaaagcggacggacgtggcgtgaagcggatattaactatacatcaggcttcagaaattcagaccggattctttactcaagcgactggctgatttataagacgacagaccactatcaaacctttacaaaaatgagataaacacatacaaaaaacggcttccctgcggaggccgtttttttgcagagaatctgcaagcttcatataaaatgagcagtaaatttttcttcaaactctgagcggtctattctgctgttttccgccgtgccatcgtgtttttttattgttatattgcgttcagacagaaccatgtgcccttccggtgtccgcttagaagcaagcaggcgtttgttgaaaggagaacgttcatgttcaaagattgtttgtttcatagacttgaggtccttttcatcgatttcttcaagcgaaaatgcgtagcctgtctgccagccgtcccctttgttcatttcaagcacgtatgtcccgaattccgtctcttctatcctcacgcggaacgctccggccgctgataccgtctcgtctcccgacatcggcacaggctgcatggcgagattgaggccgaagcctgcatcagcgatgtactcatttcccccggcggaaagaagtacggccgcatgtgtgccgggcagcgcccagccgtttttccagaccgttccgcggatcaatttgacatcaaatccggcatctttcaggatgaaataaagcagtccgttcaagtcataacaaagaccgccgtgaggttccttcaccatgtgccgccacagtccttctttcgtgacgtcatattcttttttggacaaaacggcgcggttttcaaacggaaaccgatacgcgagcgcctttaaaaactccggcaggttgctgaaatcgagggaatccttttcccagcctatcgtttgataacaatctttcagaaactcattcatcgttccgtccccttacaaagtgtttacacttcttcctgcacataagcggacaacttttccagcgcttccttttcatcgtcgccttcagcgatcagagtgacttccgtccccgtactgaccgccagactcattaatcccataatgcttttggcattcactttcttgccgtttttctcaagaaacacatctgatgcaaaacgatttgcctcctgtacaaacaatgcagcggggcgcgcctgcaatcccgtctttaaacgcacttccactttcccctgaaccataagatctccccttttctgtacggttatttcaaagtgatgctttgtcctgtacgcagctgttctgcgatttcatcgagctttctcagcctgtgattgatgccggatttgctgattttcccgcttgcaaccatttcccccagttctttcagcgtgacctcctgataatcaatccgcagctgcgcaatttcgcgaagcttttccggcagcgcttcaagaccgatccgttcatcaatgtatttaatattttccacctgtctgagagaagccccgatggttttgtttaagtttgctgtttcacaattgacgaggcggttcactgagtttctcatatctctgacaatccgcacatcttcaaagcgcagcagtgaattgtgagcgccgatgacattcagaaattcagtgattttttccgcctcttttaaatacgtaatatagccttttttccgttcaagcgttttgctgttcagatgaaaatcattcagcagggcgcataatgaatcgttatgttccttataaagcgagaagatttccaagtggtacgacgatgtttcgggattattcacagatcctcccgccaaaaacgcccctctcatataagaacgtttgcagcaccgtttcgccaccagttcctcagaaatattccgttcaaatacaaagttctccccgaggattttcaattcctctaaaatcagctttgcattttcagaaaagcgcacaatataaacattattttttttcagccgcattttttttctgactaacagttcgaccgatacatcatattgtttcttcagcaatgtataaatgcggcgggcaatcgccgcattttcggtttgaacgtcaagcacgagatggcggtttgaaaatgacagggaaccgttcatccgaatcagcgcggacagctccgccttggcgcagcagtccttcacttccagattcgtcagttctttttttgtttccgatgcaaatgacatattagccacctcatttcaaaaggcctctagtcccttaataaatcgacaagaagagaagccactttatgtgtatcgtgacggattacgccatttttatacgtgataatctgatccctgatgacctcaagccccatggatttcagcttttcaacattgaagtcgacgggccgggccagctctttcgcatatttgcttttgatttcgtcagggatctcctcattgttgattaagatcgtgtcgataaacggctgctccatatgatcgttcagcgccttgacatggtcggccgcgctgtattgaagcgtctcgccgggctgtgtcatgacgttgcatatatatacttttttggccgcggccttgacgacttcctctccgattttcggcacgagcagattcggaagaatgcttgtgtacaggcttcccggaccgataatgattaaatcggcctgacggatgacgtcaatcgtttccggcagcggatcaattttttcaggcgtaagaaacacccgtttaattcgctggccgtaagaagggattgtcgattctccggagacgacctgcccgtcctccatttcagcgtgaagaacgacactggtgttggcagccggcagcactctgccgcggacattcagcaccttgctcatttcggtgacagcgtgaaagaaatcaccggttatatttgtcatcgctgccaaaatcaaattgccgagcgaatgtccggttaagtcgcttcctttgttgaaacggtgctgaaacagattttcaacgagcggctcaacatctgacaaagcagccagtacgttacggatgtcacccggcggcggaatttgaagttcatcccgcagacggcctgaacttccgccgtcatcagcaactgtcacaatcgccgtaatatcaacgggcttatgctttaacccccgaagcagcacggacagacccgttccgccgccgaagattgcgattttcggcttcttattcatttccggcttctcttttcaatgtcccggtgagtgacatgagtatagaaatcttttttaaaatagtcagccaaatactcagcgagcgtgacggagcggtgctggccgcccgtacagccgatcgcgatgacaagctggcttttaccttcccgcttataagacggaagcataaagccgagcagatcaacaagcttttcaataaacttttgtgtttcgttccacttcatcacataggatgacacttcctcatctttccccgtaagcggcctcatgctttcaatgtagaatggattcggcagaaaccttacatcaaacacgaggtcggcatctatcggaagcccgtatttgaaaccgaatgacatcacgttcactgtaaatgtttcaccttggttcgtggcgaaatgcgccacgattttttcacgcagatcacgcggtttcatatccgatgtgtcatagatcagctgagagcgccctttcaattcttcaagcagctggcgttccagcgcgattccttcaagaggaagcccggtagcggccagcgggtgagaacgcctcgtttctttgtatctcgtcacaaggatggaatccttagcgtctaaaaagagaatgcgcggtgtaatccacggattttccgccatttcatccagcgcctcaatcagcctgtcaaaaaattcacgtccccgcagatccatgacaagcgcgaccttgctcatttttgaacttgattctttcatcagctccaaaaatttcggcagcaaggaaggcggcagattgtcgacgcaaaaatagccgagatcctcaaagctttgaatggcgacggttttccccgctccagacattcccgtaatgatgacgagctgaatatcatggttttcattcatactcatctttctcccccctgcggtctttcttttatttgataagctgcggatctaaacgatagctgagcagctcgaagtccggcgtatacgtaaaggtgccgtgcaaaagcccttggcccttgatcataaaatcaaggatatgcccgtctccgggggccatcggaaggctgtggatatcttttacgtcatgccacttcagaacgccttcctctgattcagcgacattccgccccgtgtaggagtcggcgacgaaagtaaacatcatccactctgacacgatttgttcctgttccttaataataaaggtaaacacgccttttaactgcggatttagtatataaatgcccgtctcttctctgtactctctgatgacggaatctctgacggattcgccgctttccatcttcccgccgggcgcgacccaccagccccgtctcggcttttggagaaggagaacctgatcatctgtctgcagcacacaatttgtcactctttgcacaagtacgtcacctaaccttctcaacaaatcatcgtctcttcattataccgtttcggcatgtctctcacaatgcagagacaccgacatccttttcttttatttgacagaaaacaaaaaatcgcaaaaaaagggcacggatactggaatccgtgccaaagtgtattcattaaaaagggggtcaattactacattcatcttaaaacatcagtatttcacccgtgttacagcgtaattaaaacacagtaacgattcaaaaactgaacattacagtgattatttaacggttttgagcgtttcctcaagctcttccacataatgctgaacgctttgagccgcaatacttccgtcgcctgtcgccgttacgatctggcggagcgttttttcacggatgtctcccgcggcgaaaatgcctgggacttttgtctccatttgggcatttgtttcaatgtagccttcttcatttgtgatgcccaagttttcgaacggtttagaaagcggaagcataccgatataaataaagacgccgtcagctttgaattcttcctcttctcccgtcacggtatccacaagagtaagtctgccgacttttccgttttcctcatggatttcttttacggttttgttccatttgaagtcaattttctcattgtcaaaggcacgcgcctgaagaatgctttgcgcacgcaatttgtcacgtctgtgaacgatggtgacttttgaagcgaagcgtgtcagatagacgccttcttcaacggcggagtctccgccgccgacaacgacaagctctttatttttaaagaacgcgccgtcacaaaccgcgcagtacgatacgccgcggccgcccagttctttttcgccgggaacgccgatctttttgtattccgctccggcagaaatgacgatggcgcgcgctttatattcttttgaaccggctttgaccgttttatattctttaccgtccacgatttctttaatatcgccgtacgcatattccgcaccgaattttttcgcatgttcaaacattttattagaaagttcagggccgagaatgctttcaaaacccggatagttttcaacatcctccgtgttggccatctggccgcccggaattcctctttcgatcattaatgtggataagttcgctcgtgatgtgtaaacagcagcggtcatccccgccggacccgcgccgataatgatcacatcataaattttttcttctgacaccatgattcactccttttcgaaatggggcgcaccctatatgactaagaatccccatcaatcgtattccttacccatatcctattaaatctgagggcaattcgctatttttttgctcatttttctgagaaaccgtgattagggagctcctgagcgggtatacaaataaagaaagagccttccgggatagaaggcccttgtcttattcattattgcacgacacgtcttacattgccgttgaatgctttcttccagtaagggttgctcatagaatcaatggatacaccgtgtgatgtattatcgttcaggaacgttccgttacctaagtagatgccgacgtggccgtttgttttatacgtgttgaagaatactaagtctccgcgtttcatgtcagacgcgcttactgctttacctcttccgattaatgtatctgtgtttgtgccgcttgcaggtccgagattaacgcctgcgttagcataagcccagcgtacgaatgaagagcagtcaaagatacggttgtcaatatcggattgagtgcgtccgccgccgaatttatacggagattgacccacaaggcttgatcctacgctgatcgcgccttcaataccgcctgaatttgaaataacagatccgccgtcagaatcatctgaaccgccgctgttatgagatgatccgcctgaagtgctcttcggtttgcttgagctgtcagatgaatcagatgatgttgaaacagccgcttttttcacagttttaaccgccggtgccggctggctgtcatctttttggttttggtcttcagaagctttttgcgcttcttcctgttttttgatcagggcagccgctgcagcctgctcagctttaatgcgcttctgctctttttcagtgtcagctttttggtttgcaagctgtgacgcttcttttttcagatcagagatagcggaagccgcttttttctgaccgtttttcgcttcgtcgaaaagcttgtctttctgatcaagctgtttgttcaggtctttttgcatagactcgagtttcgcaagatcatcttgaacttttttcagcttcacgttaagttcagcctctgcgtcttcgagtttcgctttatcctgctcctgctgtttgatcaggtctttatccgcatcaacgatagaagatactgcagtcgcacgggaaatgaagtctccgaagcttgtcgcccctaaaagtacatctatgtatccttgagaaccgccgttttcctgtaaagaacgaacgcgttttttcaggatttcattgcgtttttcaatacgcgcttctgtttctttgatttcttttttcaaatcagcgatctgctttttcgttttttcgttttcagcttttttatcttcgattttattgcttgtatccaacgctttagcgttaatgtctttcagttctttttcaatcttagcctgcttgtcctgaagcttggacaattctctttcttttgcttcaaggcttgaagccacctcagattgcttgctttcaattttcgcttttttgctgtctaatgtttccgccgatgcagtttttgtaaacgggatcaaaaaactgcttgtcccgatgacggaagccaaaccaagtgttaataaactctttttcactttttctttcctcccttttactttaaacctgttctcatttggaattctattatgaacatcaaagttacgctccctcacatgcccgtgaggctgatgatttttatgtacgattctttgaatctggttaattggtatagattatacagcacatgtaaaataaactaatctcttatgtacgagactcattataccatcatgtttcgacaatttttattacagttatatttcaatgtgattgcaaatctcatattttgcaaaataaacggtgattacggcctgatttcgattcaaaaagcaaaaaaatacgtatgaatacctcttttttcggcggtaaagttctgttttgcccctttataataaaaaaaagaaccgactctttatatagaaagaatcggttttattctaatatatcatctatttgtctgatgtatttcgaaagggttgccggggttataccgtaaacggcggccgtttcttttttcgtcgttttttcgccgtttgcttctttccatacgtatgcgatggctgcggcccatgcccgctcattctgtacggcagcggcggcgcggatgtgctgaatgacgtgaaaaacccagcagctcatgacgtcagtttttaaactgtcggcttccgctttctccagaagcttgaccgtccgatacgtgaacagcgcgtcaccggagacgcctgaagcgcctttttcaccggaaagcagcagtctgacgaaatcttgttcaaacggtgaaacggcgcgttttgccgtcagaactttttcaagctggttccgctctccttcagcgctgctgatataataggcggcaagccgctgttcaagtgaagcaggcagcggttcctgccgctccgcccaaggcgcgggccggtctgattcgggaaattcggcttcggcctttttccaaatggtttccgcaaattctgtgcggcctgtcccgtaggctgaggcggcaagccagtaataaaacgtttcgtcgccttcgaacccgcttttgtaaagagaacggagccatttataaccgagatcatgtctgccgacaagcgcaagcgtcgcccccagcttatagcgctgttcgaataaaatcggatacacgttggcgagttttccgctcaattctccgactttttcatcttccctctcgtaatagcagaatacaaggaggttgcacagggcatggagattgccttcatttttctcaagcacttcgaataccgtctgtttcgcttttgtaacattgcctgagtaaaagtaagcgagcgccaggttgttgtatgcagaccaaagctcggggtaatcggccgtaatctcttcaagcatgacaaccgcttcatgaagctggccgctctcaagaagcgtttttgcccggtcctgcctgatcagcagctcatcctggtcatagagcgattcgttttcacccgcttcgccgaaatccaaaagctccatcagattttcaatctcttcgctgaattccccgtccggatcggcatctgaataagcctccgcttctttgtatgcttcctgaaagagccccaaatgcgcgaaattattcgctttaaaataatgacactcgggcatttcttctttcaggttcaccaaaataaagtcgaacagctcatttgactgctggtagtggcccatttcagaataaatgacggccagccgtgacagcatttcggaatcattcggctcgagatggacggcccgctgaatcagtttgctggcccgttttaaattccgctctttatatgcttttaagcctttatgaaaaaaatattgtccatcctgaagcagctggacaatttgcgcgtgctttttctgttcagaagtgtgttttcccacaaatatcctccgttttatacgtattaccgtcagtagtataccataaaacggtttcgcctcaatagttcaaaagacaggatcggcttcgttttttactggctggttcgaccagattttagctgtttttttcacgaggctcggctggaagaatgacgcggaaaagggttccttcgccgcgcttgctctcaacctctatcgaaccgccgtgcagctctgcgattttttgggcgatggacaggccgagcccgcttccccctgcgtttctcgccttatccgctttataaaaccgttcaaatacccgctccgcctgttcaggctccattccgattccgtcgtcggcgatttcgacagccgccgctcccggcagatcaacaattttaacggaaatgcggccgccttcaccggtaaatttcacggcattgtgaatcagattcatccatacttggctgagcagcgcttcatctccgtacacatacgactcctgtaaatcaatgagaaactcaatctgtttggcggaccattcaggctcacaggtcaatatggtgcgccgcagctgtttgtcaatgcggaacggttttttttgtatcggttcggtttggcgttcaagcgcagtgagcttcagcagattttcactgatttttgataatcgttctgtttctgtctcgatgatgtgtaaatagcgcccccgctcctcatatgataaatccggttttttcaggaggtgcgcgtagccctttaatgaagtaagcggggtttggatttcatgggaaacgttcgaaataaattcttgtttcagcttttccatttcactcagttccgcggcgagtgtcgacagttcatcagccaatttcgtcacggggtggtcccgttcaatcttctccattttcctggaggcggccgctgtgaagttgccgctcgacatttgcttgatcgtggcggtcagtgaatcccagatcgcatgatgtctttcacgtgctgactttgaaaagataaacatcgttataaacagcaggccgaaaacaagccagagcgtcagaatctgctcggcgtacggcacaagcaaaatcggccatatgagaccgaatccctgaacgatcagatgagccgccagccataagaatgcggtgacggtgagaaggatgatgatttttccagccgttctgaagatccgtttcattctgtcaccacaaaccgatacccgagcccccgcaccgtatggatagcaaacggatagtccttttccggaaaccgttccctcagccttttaacatgcacatcaaccgtccgctcgtcaccttcataatcaaagccccaaatatcttctattaattgttctcttgaaaacgtcttattcggataaccggcgagcttaaataaaagctcaaattcacgccggggcagcgtcaatcccgctccgccgccgcgcgttacggtgcgggattgcttatctaatgtgacatttccgatggtcagcagtttttcagcggtgatccggtaccgtttcagcaatgctttgacccttgcttccagttcaagcggctcaaacggtttgacgagataatcatccgctccggaagtaaaaccttgcactttgtccagcgtttcgccttttgccgtcagcatcaaaatcggaatgtccgtaaagctgcggacggcttcactgacttcaaacccgtccattttcggcatcatcacatccagtatgatgagatcaataggtgctgattcgatcagccgcaccgccgcttccccgtcttccgcttctgcgacgtcaaagccgctctgctccatcatgagtcggacaagctcacggatatggcggtcgtcatccgcaaccaatatgacagccataaaaatccctccttctgcttttttgcctgtcttcttttaatgaatcgacatgatgtctattaaccatcttattttttcattgtctcctgtatcgacagacactttttttgtatggcggatcatttcctccgtcacttctttcattacgccttgatcagtatcttcacgagactcccagcgcaaaggaacattgtatatctgaatggtgccgtcaccattgctgctgtaagtgactgacccatcgactaaccgggagcctgctaactgcgtaacatcttcgggatagcgggcgctcgtatgatcgtcagggttgacgagtgctccggccggaatgcggcgaacgttcaattcatctatctgctgattttccccaagctgcagccagatgcgggcatattcaatttgcagaggagaataatctgccgacaggcttttgtccgcagagatgtgatgtgaatctttgtttactggttcttttttttctgccgctgatgctgtttcagccttgttgatgccgctgctttctccggccggacttgaagaatggctcggctcttcatcgttaccgtccgtacacccggcagtcatgaatacgagcagtaaggccgcgtgccaataaaaaatctttgtgcgttttttcataatttaacccccgctttctatgaagagaactccggctgcaaaataaaaagcagctttttcagctgctttctattcataaagtcttgctttacacagctttgttttctaagtcggcattcagcttcagctgctgctccgcaaaatcgcggtacagcgaatgggatgccattaattcatggtgtgtgccccgtccggtgatttcaccctgttcgacaaagagaagctgatctgcatccacaaccgtggataaacgatgggcgatcacgatcgtggtgcggccttccattagaacttccagcgcctgctgcacccatttttcagattggctgtccagacttgatgtcgcttcatcaagcatcagaatgctcgggttgcgaaggagcgctctggcaatggcgatgcgctggcgctgtccgcctgacagcataattccccgctcaccgacctctgtttcaaatttcttcggtaagtcttcaataaattgcagggcgtaggccatgtcagccgcttgcctcagttcctcatcagtcacctcgcgttttaatccgtagcagatattgtcgcggatggtgcctgacattaacgggctttcttgcgacacgtagccgatatgctcccgccatgactcaagggaatacgcatcaatcggttcatttccgagcaggatgctgcccgcagtcgggttgtagaatcgttcaagcagcttaaataacgttgttttcccgccgccgctcggtccgacgatcgcggtgactttgccggcctcaatcgtagccgtaatgtcttttaagatggtttgatctgttttgtagccgaatgagacttgttcgagcttaatcggctgatccgcgttttcaatggcttttccgatttggatatcttcttctttttctgcaagaatatgaatcatccgttccgttgcgccgacggatttttgaagctgtgtgaaaaatgaagtgatctggcccatcggcataatgatctgaaacaaatacaggataaaggcaacgagtgcgccggctgtcaattcaccggatgacacctgcatcccgccgtacccgatgacagcgaccagcgccgccattaatacaagtgtaataagcgggcctacgagcgactgcaccttcgcttcacgcagcccgagtttaaagagcgccatgatgcctgcttttccgcgtccgtattccgcttcttcagcgtttgacgcttttacaagcctgatttccgggaggatgtggtttaataatccggtgaatctcgccgtttcatcctgtgtttcccgagaaattttaaacattttccggccgatcggcactaaaatcaccgcagccagcggcacgacgatcagcacgagcaatgtgagcttccagttcatgaaaaataagatcgtcagtgacccgataacggaaatgattccggtaataaatccgctgatattgtttgtgatcagctcttttaccaccattgtgtcattggtgacacggctgatcgtttctcccgtggcgtttttgtcaaaataagagacgggcagtttaattaatttctgccacaacaaatcacgcagtcccgagatgattttctggccgctgtagttcagggcgtaggtggcgtaggcgcttaatgcggcctgtacgatgaacacggctgcgatgattccgatttgcacgcctgacagcgacgacacggaaaagccgtcaacgagctgctttgtcaacagcggaatcagcaggctgacgagcgttgtcacaatactgagagacagcgcgaaggccagcataccgtatgatggttttgtttttttgactaatgaaaagaatgagctgaatttcccttttggttttggttgtttattcggcatatgttttcctcctatatcactgtttatactataacggatgtgcatgaacggaatatgaacaaaacgtatatttttgataaaaaccaaaataaactctattagtcaatattatcaaattcatctgcctacggttgcggaaataaggaatattttattgaatgtttaagtttgacagaataaaaacctcacgggtctctccgcgaggtttgttttactcagatgcagaatggcgtttcgcaaggacgtcaagcacgtcatccaaaggaagcgactgctcacgcagaagaacgagcaaatgatacagcaaatccgccgcttcccattttaattcttcatggtcgcggttttttgcggcgataataacctctgcggcttcctcaccgacttttttgaggattttatcgacgccttcccgaaacaggtacgttgtgtaggctccgtcaggcatctccgcctgccgtttggcgatcacgctttccagttcatttaagatgccgaaacgatcctgcgcgtctgctttttccgtggaaaaacagctgtagcttcccttatggcatgcgggtcctgagggctccgcaagcacgacgagggcatcttgatcgcaatcataacggatggctttcaccttttgggtattccccgatgtcgctcctttatgccacagctccccgcgtgaacggctgtaaaaccaggtttctttcgtttctatcgttttttcataggattctcggttcatataagccagtgtcagcacttctttgcttgccgcatcctgtatgatggcgggtatcagtccggcctcgtcaaaccgcagttcatctgcctgtttcatctcacattcaccccgtgtttcttcatataatctttcacttcttttatagatgtctctttgtaatggaaaatagaagctgcaagcgcggcgtccgcttcaccgactgtgaaggcttcaagcatatggcgcgcgctgccggctccccctgacgcaatgacgggcaccgggacggcacgtgagacaagctgtgtgagcgtatgattaaagcctgttttttcaccgtctgcgtccatgcttgtcagcaggatttcacccgctccccggctgacggcttcttttgcccaggccgtgacttcccgctcggttttctgtctgccgccgtgtgtgtacactttatagcattccgaatcttcgtcatactttgcgtcaatcgccgctacgatgcattgcgagccgaaaaactcagctccttccgtaatcagctcgggacggagaacggccgctgtattaacggataccttgtcagcgccggcgcgaagcattcgtttcatatcgcttaattgattgattccgccgccgaccgtaaacggaatcgccagttttgccgcaacttgttctacgacgtctgtcatcgtcttgcggccttcgtgagaggcggaaatgtcgagaaaaacaagttcgtcagcgccctccctgtcgtaggcttcggccagctcgacaggatcgcccgcatctttcagcccgagaaattgaatgcccttgacgacgcgtccttctttcacatcgagacacggaatgattcgtttcgtgatcatgcgtccttcacccttctgagcgcttcagccaatgaaaattgttttgtatacagcgcttttccgataatcgctcccgatacgccggcgtctttgaagcgggccagtgctttgaggtcggcgactgagctgactccgcctgaagcgatgacgtcttttcccgttgcttttgcgagctgaacggtactttcgatgttcggtcctgacagcatgccgtcagttgcaatatccgtgaaaatgaaggtttccgctccttcggccgccaattcacggcccagatcggccgccattaccgaggatgtttccagccagccttccgtcgagacatatccgtttcttgcatcaaggccgatcgcgattttgccgccgtattgtttcagcatgctcttcacaaatgccggatcggaaacggccgagctgccgagaatgacgcgatcaacgccttgtgataaataaccgtacacatccgcttcagaacggataccgccgccgatctcgactttgacatcaagctgccgcgcaatgtcaagaacatgcctgtcgtttactttcctgcctgctttcgcgccgtcaagatccacgagatgaatccattcggcgccttcttgtgcaaattgcgccgccatgtctaaaggagagtcaccgtatatcgtttccttgccgtaatcgccttggatgaggcggacgcatttgccgtttctcatatcgattgccggatataatgtaaaagcgttcatttcttcaccttctgttccgctgccatttttgtaaattgtgttaagatcgccattccggctgtaccgcttttttccggatgaaactgtgcaccgaaaacattgcgtttcccgacgacagccggaacacgaacgccgtactcagcgcttgccagaagatcgccgtcttccatcccgtctatataataggaatggacaaagtaaacgaagccttcttccgcttccgaaagcaaaggagacgtttggtgaaacgtcagccggttccagcccatatgcggcaccttcagcttgtttccttcggcatctctgtctttgagtctcacagcttttccggctaataaaccaagtccttttgcagagccgttttcggcgctctcttcgaaaatgagctgcatgccgaggcagatgccgaggagcagcttaccctcgtcaaccatacggtgtatgaattgatcaagcttcgtgctgcgtaaattgtccatggcgtcactgaatgatccgacacctggaagaataaaagcatccgctttttcaagctcttccggccggtctgatacgacatacgggacgccgacgcgttccagcgctttcgacacgctgaataaattgcccataccgtaatcaattacaccgatcatttacagcattcctttcgtagacggcacacccttgacgcgcggatcaatggatgacgcttcatcaagcgctctgccaagcgccttaaatacggcttctatcatatgatgggtattcgtgccgtaatgaacgatgacgtgcagattcattctcgcttcgagcgccagtttccataggaattcatgtaccagctcggtatcaaacgttccgactttcgcttgcggaaatgcagcgcgcatctcaaggtgcggccggttgctcaggtctacggcgacttgggcgagcgcttcgtccatgggcacaagcgctgatccgtaccgtttgatcccttttttatcaccgagcgcctccaaaaaagcctgccctaaacagatgccgatatcttcagtcgtatggtgatcatctatctccgtatcgccttttgcgtcaaccgttaaattgaattgcccgtgctttgtgaacaaatcaagcatatgagtcataaacggcacatccgtgctgatgtcggcttttccttctccgtctatttcgaaagccagccttatatccgtctcatttgttgttctggcgcgttccgcttttctcatcggtcattcctccgtttctcgcttcaatcgatcttgcgtgcgcttccagcccttccagtctcgcgaaggcggaaatgctgtccgcgtgcgtttcaaatgccttccggctgtaagagatgatgctcgatttcttttgaaaatctgttacattcagcgggcttgaaaaccgcgccgttccgtttgtcggcaaaacgtgattcggtccggcaaaataatcgccgaccggttcagcgctgtatcgtcctaagaaaatcgcccccgcgtgtctgatgcttccaagcaaagcctccggcgaatgcgtcatgatttctaaatgctcgggcgccagctcattcaccgtgtccaccgcatcttccatcgattccgtaatataaatgcggccgtgatccctgatcgacgcttcggctatttctttgcgcggcagggtctgaagctgtttattcacctcatctgataccgcttcggcaagcttctgtgaatcggtgacaagcacgcttgaactgagcatatcgtgttcggcctgtgaaagcaggtcagcggcgacttctttgggcaccgccgtatcgtctgccaggaccacgatttcacttggcccggcaatcatgtcgatatccacaacgccgaagacttcgcgcttcgcgagtgctacaaatatatttccggggcccgtgatcttatcaacaggctgtatcgtttccgttccgtaagcgagcgcggcaatcgcctgtgcgcctcccgctttgtaaatttcctttatgccgagctcagacgccgccgccagaacgcccggtgaaaggcggccgtcttttcccggaggactgacgagaacgatccgttccactcccgcagcgagcgcggggatgacattcattaaaacggaagacggataagcggccgtcccgcccggcacgtatacgcccgcggaatcgagcgccgttattttctgtccgagcatcgagccgtctttgcgatggtaaaaccaagaggattgcagctggcgctcgtgatattctttaatattggcaatcgcctgtctgatcacttccagcagctgatcatcaagcagacggtatgcctcggtgatttcctctgcgctcacggccatttggttcaggctgatgccgtcaaatgtttttgtataggccaaaacggctttgtcaccgttttgtctgacgtcttcaataatccccctgacggttttccgctgctcttcggttccgctgtcgatggaacgcttcagtgaaaaccgctcgcttctttttactgcggttatgttcattttgccgtttctccttccacaacccgtgccagcctggccgccatttcgtcgattacatcatccttcatgcggtagctgaccggattgacgataaaacgcgatgtgatgtcacaaatatgttctgattcaacgagaccgttttcctttaatgtccgcccggttgatacgatatctacgattctgtcagcaagcccgattaaaggcgccagctcaatggagccgttcagcttaatgatttccacctgctcgccctgctctctgaaataactcgacgcaacattcggatatttcgtcgcaatcctcggtgcgactccgttccaatccgccccgggaagccccgcaacggcgagatggcatttgctgattttcagatcgagcacctcatacacgtcacgctcttcctcaagcatgacatcctttccggcaataccggcatcagcgacgccatgctcgacataagtcgtaacatccatcggctttgccagaataaagcggagattttcttctggaacgtcaatgatcagttttctcgattcttcaaactcctcgggcagcctgtatccggcctgcctcagcaacccggccgcttcttcgaatatccgtccttttggcattgccattgtgagtaccttacccattcctctcttcctttctggcaccgataaagtatgtgacgtttgcgaatgattttgtcatatgatcgatattttcaatgcccgccagatcctgcaggacgacttttctgcctctcgccctttcttcctccgcgaataaaatagcctgggcccgctgctccttgctgaaaatcacggcgtccgcttcacttgtttcttcctgaatgccgagcgcttcaatcagcctgtcgatacggagcccgaagcccgtggcgggagcgggactgccgaaatggccgaggagattgttatagcgtccgccgcttccgatgacgaaaccgacatttgccgcgtacacttcgaataaaattcccgtgtaataactcatatggcttaccatattcagatcaaggcgaatatgctcggcacatccgtaatcctcaagaatgtcccacaggtcttccagctcctgaattaagctttgtccggagattccgatgatctcctccgctttggcgcaaatctctttcccgcctcgcaattccaaaagtgcgagcagccggcttttgtctattgaagaaagcggaagcgatttgacatgttccctgtatcccacgtaattcttttcaaagagaaagcgccgcagaacatccgcccgctcggcattgcccaaaacctcgacaaacagctcatcagcgagtccggcatggccgatcgcgattttaaaccggtgcaatcccgcgtttttcaaagcgccggccgccagcgcaatcacctcggcgtccgcgcttgttgatccgtcgccgatcagctccgcgccgacctgttcgaattcggccggacgtccgccttcccgctcctgagcgcgatagacgcttgccgcgtaccccgctctgagcggatgattgtgtttgtgcagcttagatgccgccaccctggcaatcggtccggtcatgtcgggccgaagcacaagcgtttttccgtcctgatcgagaagcttaaacagctgctgttcttcaatggctgactggacgcctactgtttcatagaattcaagggtcggcgtctccataaactgataaccccatttatcaattaaatccgtcagtgtggaacggacttttttcttggcttcgtataaaccgggcagcgtatctctcatgccatgcggtttctcaaacataaacatttgccttttacacctccgctttgtctgaaggaaaattccgaatcctttagttcgctaatatgataatatgttagcagataaaagaatggattgcaacgcccaatgtccgcctattcttttccataaacatggctaaagaatgaacaaacctgtaaacatatcggaacgatcgaatcatattgagcagaagtgctataatacatagaacagcttcatcagaaacaagggagaataattgataatgaagacgcttggaacattatgtgtgctgattctgacagccatccttgtctatctgggatataacatctatacaaacgatattcatttaaattttttcaatcagcagtccgacgagcctgatgagaaaacaccgttaaaagggagcgcgtcaccgctgaatgtcgttctgtacagacagatggattctcccagactgtacaatggctgtgaggtgaccagccttgccatgattttgaacaatgccggatatcatgtgtcaaaaaatacattggcggataaaatcaataaagttccgctcacatacagcagcgggctgaagggagatccgaatgaaggatttgccggagatatggaaaacggcccgggtttaggcgtttatcatgagccgattgataaacttgccaaagaatatgcgggaaacaaagtatacgatcttacgggaaaagacatttcttcagtgtaccgccagcttgaaaaagggcggccggtctgggtgattaccaccacatcctttaagccggttgatcatatgcagacttgggatacaccgaacggaaagatcgacattacgttcagcatgcatagcgtagccgtaaccggttatgatcacgattatgtatacgttaatgatccttacggctataaaaacagaaaaacagaccggtctgactttgaaaaagcctggaagcagatgggcagccaggccattgtgatcaagtcataaaaaaccccgctgacgttaatctgcggggttttccattcgttttttcatttcttcgtgcgtataaatcacctgcatcggatttcctccgacaaacgccccggcggggacatctttgtgcaccagcgtgccggctgatacaacggctccgctcccgatggtgacgccgggcagaatggttgtgtttgccccgatcatcacctcgtcaccgattgtgacaaaaccggtccggtactcacgtattaaatattcatgagccaaaatcgtcgtattgtagccgataatgctgttttttccgacagtgattttttcgggaaacatgatatccggcatcaccatcagcgcgaatgacgtctgttttccgacattcattttcaaaaaggttcggtacagccagtttttcacgcttaaaaacggcgtataccttgcaatctgaatgatgatgaaatttttcatcaccttcaggaagggaaccgtctgataaacatgccacaatgaatttgcacctgcaaccggatggcggtctgtttttctcacggattacttcactccggtgatgtgcaataaatcactcattttctcgagcatataatcgggttcataggcggaaagcgtctgtgcgcctttaatcgtccacgcgacgccggctgttttcgtgccggcgttttttcccgccatgacgtcgtgataattgtcaccgaccatgatggcttccgacggatcgcacccaagccggctgagcgcaagccgcacaggctcggggtcaggcttcgggtgctttacatcatcaagcgtgacgacagtatcgaaaaacgccccgatgcctgtcagcttcaatcccatattgactgtatccctcagcttagtagtgacaataccaagctgatagcccgcttttttcaattcatccagcgtttcataaaccgtttcgtactccgtgacgagctcatcgtgctttttatggttgaatgctctgtacatgctgatcatgtcatcgcacttttcggcattaatgcctgaaaacgtttcgtacagaggcgggccgataaacggaagtacatcttcccttttaaactgccccgggcaataatgatcaagcgtatgaaggtaagaagcgataatcagttcattcgtgtcaatcagcgtgccgtcgagatcgaataaaatggcggttacatgtttatcagtcatcttatgtcctttccgatttcagtcgtcagtccgtgtcagcataccgcttatcggcataccccttcatgcgtctgaaaatcattaaaataatcgcaagtataatcagcacaatggaaatgacctgcgcgatccgaagctggctcgtaagcatcaggctgtccgtccgcattccctcaataaagtatctgccgattgaataccagatcacatacgtcaaaaacagattgcccctgcgcaggttcacgcggcggagcagaagcagaatcacgacgcccgcaaaactccacagcgattcatacaaaaacgtcgggtgataatattgtccgtctatgtacatctgattaatgatgaaatccggaagatgcagactttccaaaaatgaccggctgaccgctccaccgtgagcctcctggttgataaagttcccccagcgtccgatggcctggccgagcagaatactcggcgcggcaatatccgccagcttccagaatgagatgcctcttacttttgaaaagacaattcccgttgcgatcgcgccgattaatccgccgtgaatcgcaatgccgcctttccaagttttaatgatttccccggggtgttccgagtaatagctccactcgaaaagcacataatatgcccttgcgcaaatgattgcgatcgggatggcgaaaagaacaagatcaataaaaatgtcctttttcagcccccgcttttcactctccctcatggccatccaaagccctaataacgcgcccgcgccgataatgatgccgtaccagtgcacggataaaggcccgagctgcaaggcaatcggattgatcggtgttccagcttcattcatattattgccaactcctattcgtcttgttcgccgtcctcaatgacatccgccagcttattcgtgaattgttcggcagcatttaagcccatccgcttcaatctgaagttcatcgccgcaacttcgataataacggcgagattccgccccgggcggacgggaatggtcagttttgtaatttccgtatcaatgattttcattttttcttcttcaagtccgagacggtcgtattgctttccttgctcccaaagctcaaggtccatgacgattgtaattcttttattgcttctgacggcgcccgccccgaacagcgtcatgacatttataatgccgagccccctgatttcgagcagatgctcaatcagatcaggcgcgttcccgacaagggtatcctgatcctcctgccggatttcaacgcagtcatccgcgacaagacgatggcctcgtttgacaagctccagcgccgtttcacttttaccgacgccgctttttcccgtaatgagcacgccgacgccgtatatatccacaagcacgccgtgaatggccgttgtcggcgcgagacggctttcaagaaaattcgtcagcctgcttgacagcctggttgttttcagaggggatctgagcacaggcacgccgttttgctcggaagcttctacaagctccggcgggatcggcatatctctggaaagtatgatagccggcgtcacatcggtgcacagcgatttcatccgctgtttcttatcttcctcgggaagctgatcgaaaaatgacagctccgtttttcctaaaagctgcacccgttctctcgggtaatatgtaaaataaccggcgatttcaataccgggccgtgataaatcactcatcgtaatcgggcggttaatcccttcttctccgctgatcaattctaaatggaactgttccattacgtctttggtccgaacctttgccaagatatgttcctcctgttctgggatgttccgagctttgaacagttatattttatcactttaccgtctgaaccaaaacagatttatacaattccggcataactggtctagataactagtctgaaaaggagtaaaataaaactaacaactaaccagaaaggcgtgttttaaagtggctgaaagcttgttaatcagcggtgcggacatcgtaacagaaaaagaaatcatccgaaacggttttctcggtataaaggacggcatcatttcttacgcgggaaaaacaaggccgcaagaaacgtatgagaaggaatggaaggcgcccgagggctcgtatgcgcttcccggaatgattgatatccatattcacggcggatacggcgcggatacgatggatgccgatgttgcggctcttgatacactgtccgcccggctgcccgaagaaggaacaaccgcttttttagcgacaacgatcacacagcagcacgaaaacattgaaaaagcgctcatcaacgccaaaaaatgggcgtattcctcaccggagacccaaaaaggcgctgagttgatcggcattcatttagaaggaccgtttgtctctccgaaaaaggcgggagcacagccgaaacaatggattactcctgctgatgccgggctctttcagaaatgggagcggctctcgggagggctgatcaaaatcgtgacgcttgcgccggaagaagatcctgatttcagcctgatccgttatttaaaaaaccaaaacatcatcccctcaatgggacacacagacgcaggagccgagcttttacaaaaagcggcggatgccggggcggtgcatatgacgcacctctttaacgccatgagctcctttcatcaccgtgagccggggggcatcggtacggctctcgcctgcggccgcatcacggcggagctgatcactgacggcattcattctcatcctctggctgttaagcttgcctatttggcgaaaggaagccaaaacctgatcatgattacagactccatgcgggcaaaagggcttaaggacggagaatacgaattcggcggacaaaaagtcaccgttcgcggggacacggcgcttctctctgacgggacgctggccggttccattttaaaaatgaatgaaggcgcggcgctcatgcgcaggtttacaaactgctcatggccggatatagcaaatatgacatcggcaaatgcggcccgccgcctcggcatattcgaccgtaaaggaagcatcgccgaaggaaaagacgccgacgttgttctgacggacggacagtgcggcgtgctggccacgatttgccgcggaaacaccgcatatatctcaagggaggctgattggacatgaacgttatcacatgcagacattatgaagaattaagtgaaaaagccgcagcgattatcgctgaaacagtgaaacaaaagccggatgccgttctcggccttgcgacgggaggcactcctgaaggcgtatacaaagaacttgtgcggatgcaccgctcagaaggcttgtcgttccggaatgtcacgacgatcaaccttgatgaatacgccgggctttctcccgaggacaaaaacagctatcattattatatgaatacacatttttttgcacatatcgacagccgaaaggaccgccactttctccctgacggacgggcagacgatcttgatgccgaatgcgggcgctatgaccgattgattcaaacactcggcggagcggatatacagcttttaggcatcggacacaacggccatatcggctttaatgaacccgggacgccatttgaatcccgaacccatgttgttgagctgaatgaagagacaagacaggcgaatgcgcggtactttccgtcaattgatcaagtccctgaaaaagccctgacaatggggatcgggacgattttgtccggcaaacggattctgatcatggcatccggaaaaagcaaggcccaagcggtgaagcagcttctggacgggcgcgtcagcgaagcattccccgcctccgccctgcacgcgcatccggatgtgacggtcttgattgatgaaaaggctgcgggcggcgattgaaaggatttgacctatgcagattgataaacaatctccgattccgatttactttcagattatggaacaattaaaaacacaaatcaaaaacggcgagctgaaagcggatgcgctgcttccgtcggagcgggaatacgccgaacaattcggcatcagccgcatgacggtgcgccaggcgctttccaatttggtgaatgaaggatttttatacagacagaaaggccggggaacgttcgtcagcaaactgaagatggaacagccgcttcaagggctgacaagcttcaccgaagatatgagaagccggggcatgaagccggggagtagacttgccgaataccagctgattcaggcgacggaagaattatcttctatcctggggtgcggctatccggcaacgcttcataaaatcatccgcgtccggctggcaaatgatatcccgatggcgattgaggcatcgtatatcccgtttgacaaggcgggaaaattggatgcctcccattttcaatcatccatgtatgagcatattgaagcgtacaatcagatgccgatctcacgggcaaaacaagagcttgaaccgggaaccgcttccgaggaagaagctgagctgctcggtatccagcccggcgcccccgtcctctatatcaagcggaccacttatctgcaggacggcactgcctttgagcacgtcaaatccgcctacagaggcgaccgctacacattcgtgcattatatggacagggtgaaatgaaacatctccaaccgttacgggttggagatgtttttttgatctgccattttcaaatcaagccggtgaatgttctctatgactctgtcaaaacgaagaggctggggttccggtatctatttttataaagaaaagagtaataaaatgctatcctctgttttggacaatatacggaacctgctttgaaatcagcagcagcggttctttgtttttatgagccaatgaaaacatgattgcgccttcaatcatcgagttgattgtcatcccaagcttctccgcttcctcttgttcaaacccatgctcaagaaattttgccgcaaacacatccgtccacttcttgaacacctcaacacatgtgcatcttaacgtttcattgatcagagcggtctcacccgccagcaatccaaccggcacgccctcaatattctgcggatcattaaactgttcagccgttacatgaataaagtgctgaatcgcttctacagggtccgcggattgagacatactattctgtatctgcttttcaacgcatcttcccgtatatttgatcgccgcaatggcgagttcttcttttccgtttggaaagtgatgatacactgaccctctgggtgctccgctctcttttataatttgattcaaaccagtcgcatggtatccctgaatctgaaaaagatatgcagaggtttgaataattctttcttttgtcccggttttactgttcattatgtttcctcctgcatattacgaaaaccaatcgattttagtatagaaaagggacataaaaaagtcaaaaacacttaccgccatgcatgttacagaaaaaaacctgctgaccgtcagattttcttctgaccgatcggcaggtgtatgtttttgctatgggtttgaggcatgcctgaaatcaaactgatccggagccgggtgatacggcgtatttcccgttttgaacatccacagcggtgatattgttttgccgttgtacgggtccttcacgacggtgtaccagtaataaacggaatcaggctgcaggccgtcccagacccaatttgcggtttttccgctttttacgtgttttttatgaccgagcagttcgttcgtataaacgttgcattcaaaataatcagtcgctacccttttcctcttcggctgtaaatccatttctgctgagaattcgtctttatcagcgaacagatcggtgtcatagtaattgatgtcatccgtgtacggcgagtaggagaacatgtgaacctgattggcggcctgatcaaattgcattatgcgcataaagccctgcccccttccggaccgtcctggtagtcggtcagaatttggtggacgaggcggtccggttttccgtctccgtcatcgtcaagcgcatcggtttttttcatggcgttatggtaatggccgcttaataccatcgccacattgcgattcggcttgacgacttttcgatagatcgtctccccgatcgggcttcgatttccgctcacaagcaagtactcatgaaagcataagatggcggttcggtccggatacctcttcagcacttgattgatccagtcaatctcttgttccgtaatgccccagcccatataaatcataataaaatcgttcccgcttgccgacagcagatcataatgcccgcggttatttttgtatgatccgccgtaatgcatgttctgttcaaaccggcggctcccgaagaaatccccgaaggttcggtatgtgccgtctttatggccgacgtcgtgattgccggcaagcactccgtacggaatccccgccttgtcaagcgtccgcatggagtgatcggcgtttttccactgtttcatcaccattgaatcatcgacaatatcaccggtatgaaagacatatttaatattgtgcttttccttattttctttgatccactccgtcattttgtcaaaaatgtgcgggtgcccttgtgcgtaatactgtgtatccgacatccagacaaacgtgtaattgcctttcgccggtatttgatcctgcacgatgacattcatttttgagttcttcaccacatccgctgcggaaacggcggcttttaatgtaaacggctttttatctttggcaaggacgctgtccgcctcctgccagcggcttgtccggtaattccaaatatacatggttacctttcggccgggcagagagcttcctttccagaccgcctcggccagatccgtttcgtcgatagacgggtcaacggagacttcgaaccggtgataaggaaaacgctccacactttccgccgaaacggtttttccgtcatttgccgagatacggttcatttccggcagggtaaacggcatttcattttcttttatgcccttcggcggttccgttaatgaggcgtgtttatacactttcacgctgcccggattccgcgcggtataacggaagccgcgataaaatgatacattcatgtcatccttcgtcgggtcttttacccggacggacagctttgctttgcgggcgccgattttttgaccggcaagctccggctggttcggctcctcccgtttgatatggaaggtgcggacggacgttgtttcatttccggcaaggtctgccgcaatgatagtaagggtgtgctttccgggcttgagatcggctgatgacgtgtgatgcgggagcgtaatgctttctccgtccaaaaacgctttcacctcttccactttgctccatttatcacggatgtccgcattcagctcaacattacctttcagcgccgcgccttctttaatacccgggacaatcttcggccccgaattgtccaccctcacagattggctcagctgctcctcaccgtcactgacaaaaatatggtgatagccttccgaaagcttcgccgtgttccacggcagcagccgtgacgtaaacaaatgatccggcaggctgaatgagaaggtcttctgctgattcgcccgcttgccgtcaccgataaacagctgctcggacgggtccgtcttcccgtctttgatcaccgttccgtccgaaagcaccagacgggcatgtttcacgacaaaatcatcccgattctctcccgtgtcatacggagaaacctttgagcccgaacggatggatactttctgtgttttgcccccttttagcagcagacgttccggaagcagaaccgagtgcgttctgtagcggtgagacggatcgtcaaaaatgtgcagcacctcgttttccatcatgacggtgttttgaaaataaagattcgttttccgggcatcgaaggcgaaatagacctctttttccagcgccggccgggtctcctgccgcttgccgtcaatccacagcttgatcttatcggcgctgacgtcggaagtcgctttgagcagataggtgccggatatcgtatcttccggttcaacattcattctgagtccgtgtgatttgctcgtctgttcaatgtcaatcatcttgacgggcgtttttgcttcattttctccatcactggctgcgatataatactcaagctgatcctggccgagcagttccggggaataaagaatgtgatggtataagctgtcgttgcggtctttttcggccagaattcgtttgaatggttttttctcattggtccggtaataaaacgcggctgttttgacaaggtttttgtcttttatgtcagcctttaattcaatgctttcagcgggccggacgggctttctgtctgtaaggtcttcgatgaccggtttttccttgtcgggtttgatcacccttttctgctgcggaatctgcgcctgaaaaacggagcccggtgacggcttatgctcgctcgtggagatcttcagcaattctcccgttccgttcagcggatatttgtacagcaaagaagtcagccggcggaaagcgtgtttccggtattgcgctgaggcgatatccttgccggtatttgccgacagcacgaccgtacgcgggcggccgttggacattccgtctgtcccttcgatgacggcgagatgttctccttccttcagacgtgtcccgtaatagcggttgaaatcatctatcgtcagttctgatgcggcgcgtctcagccaaaacacgtaagtcccgcctgacggaatgacggtatcctctttcggcctccatatcatatctgattccggcccttccttcggatagcggtagcggatatgatagtctttaaaatgaatgggcctgtccgtcgtgttatacacctcgataaattcataggcatcagcgccatcttcatttttcgtatcaaccgcaagctccgtaatcatcagctcgggaatatgattcaaatcggcttgatagccgtccagcttcagccgctttttctccgattccgcccgctgtctgccgttggtgaaaacgaggtaatattccaattctccattccagatatcccgttttgaaacctgggccgtaaaaagccggattgcgcctggcgcgggctccatcggcaccatcttaaaccccagctcattgctttgtttataaaaaagaaacgccgaaaacgcttgatagtcagcattccgtacatgagcctgtatgaacaggtttcttttcatttccgcctttacttcgatttggggaggattctccagaagcggtatgtaatgaggcggctgtccgaattcctgctgattcacggggattgccgattctttgcgcgccgcatccgcagaaggactcacacaaagcaaaccaatcagaaaaaagagcgtcatcacaagtttcatctcattacctccctatgcattatgttgcgtcaggaggctgccgcttatgtaaaccgcacataaaaaagctgccctctcgggacagcttgttttttatccttttctaagcggctccaatatgcctttttggatcagcaagtggaaaacggacagcacgacggatgcccaaatggcggtgccgaacccgtcaatctgaaagctgtctcccatcaaggctgcggtcatcattaacgtaatggcgttgatgacaaacagaaagaggccgagggtcacaaccgtgacaggcaatgtcaatatgacgatgatcggtttgatcagcacatttaacacagaaagaatcacactggcgatgacagccgctccgatactgctgatatggacggaatcaaaatatcccgcgataacgattaataataaagcatttactaaaatgctgactgcccatttgatcatttatttcaaatctccttctaaaggtacaacaaaacaccagataatatatacaatcggcacgattccgctcgtgacaagcgctaatacaacggtgataatgcgcaaaagcgacgcatccatattgatgtactccgccaaaccgccgacgacgccggcgattttacggtttttttctgaacggtaaagtcttttcatccaatcacctctgagtatgcttgagcttaatggctcctgttaacgattctgagaaaatcgagagatgctgatcatggccttgatttgatgccagcatcagttctttttgaatggtatcattcttttcctttaaaatttccgcatcaatcagctcatggctgagagagccgagattgcttttgagctccgctttcaccgccgaatcatcaggcagggcgatctccacgtttccggtcgtcgttttcgtgtagatggagcggcagtgcggcgctgtcacggtaagcatgatattgccgttaaagctttgaacgtcaatggattcactcgatccgcgcaaatcaatcaagccgttgatcgtttccgcttcaatcgcgccgcattgatgtccggccagcttgatttgtccgttagccgtttccgccgacgctttctcagccgtcaaatgagagaatgacagaacgccgtttgtcgttttcgccgagaattcttttacatgtaaatgttcccctctgatcggtccgttaaacagcttcactcttatcttatcgtactctttctgaggaacataaagcgtaacattggttttcatcgttttcttttccgtgcggacaaaaaacttattgcccttcacttcacactcaatatgctgaagaaatgcggtgcgcgccgcctcctgactgtccgcccggtacactttcgcctggcactccgctctgatatcttcatccgcccacggcacgatattgacgctgccgtttgcaatctgcatatcaatggccgagaattcactgtctttaaattgaaaaatatgctgcacttcgtgtgcgtggccgaaattcagatcaagatccgcttccttcacttttttgacggcagaatcaatccagtcgaacagcttcgccccgagcgacggcttttggcttccttttgcaccgctttcgaaatcttccgcaggttcctgaacctccgcagataatgcggtgatctgatcttctttttctttatattcatgatccagtttttcaatgagcgtcagtgcttcctgcgccgtcagcatgccgtcttccacaagctttaaaatccgttctttctcctgtttcatacaaaactcctcccccgacttttcttacacctggcgtaacaccttaattccctgcacgatattccaaatgaccattccgatgaggatcagaaaataaacagctgctcctgttatcataacaaaaacgggcaccatactctccccctgggccgtaatcaatccgccgacaacaccggcggtcacaatcagcaagcccgcaaacggaatgatatgggaaatcagagcgcgcatggcatgccgcttcgtctctttttcatcgacgacaaagtaagccacaatcggaagaatgagcggcgcgagaaacacgctgaaataacagattgatgcgataatcgcttgatttcggttcaataaaaacactccctgtgccatgatataaaaaaccattccttatacatacgtatgacgaatgagcgggtttcattttcatgctaaggacatgcttcgttatacgtaatttttggtttcagagatttcactatagaatcttttccccgaaccgattacaatatgtaacaaagcctgaccgtatgcaaggaggacatacaaatggagaaagatcccgaaaacgcccaagtaacggaagagagtcttcgaaatttaattcgcgaacagaaaagaatgaacagcgaaatgctggctgaattagaacagatcaaagcagcccctcttcccatttcccatgatatccaatatataaaagtgctgctggacagcagcagcacccatattctgcaggacttaatgcatttaagcagacagcttccccaacagaaaaaaagcctgtaacaacaacagcccaaaaccgatgagttttgggctgtttttattgatctattacgtggctgccgtttctttttcggccagcaatgttttcatccgttttttatcgcgttccattaccggtttcagatagcggcccgtatatgattctttcacttcgacaacttcttcaggcgttccggaggctacgatcgtgccgccgcccgctccgccttcaggtcccagatcgacgatgtagtccgccgttttaatgatatcgagattgtgttcaatgaccaaaacggtatcaccgttatcgacgagtctttgaagcacaaccaaaagccttgcgatatcatcaacgtggagccctgttgtcggttcgtccagaatatacagcgtccggccggtggaacgcttatgcagctcggaagctagcttgacgcgctgcgcttctccgcctgacagcgtcgtcgccggctggccgagcgtcacatacccaagtccgacatcagcaagcgtttgaagcttgcgtttaattttcgggatattttcaaagaaagacagagcatcttccaccgtcatatccagaacgtcggaaatgctttttcctttgtatgtgacctcaagcgtctcccggttgtaacgtttgccgtggcacacttcacacggaacgtacacgtcaggaaggaagtgcatctcaattttgatgatgccgtcgccgcggcaggcctcacagcgcccgccttttacattaaaactgaaccggccttttttatagccgcgcacctttgcttcatttgtctgcgcgaatacatcgcggatatcatcaaacacacccgtgtaagttgccggatttgatctcggtgtccggccgatcggcgcctggtcgatgtcgatcaccttatcaagatggtcaaggcctttgatttctttatggcttcccggtttcgctttggctttatgaagcttttgcgcaagcgccttatgcagaatttcattcacaagcgtgctttttcccgaaccggacacacctgtcaccgccgtaaaagtgccgagcgggaatttggcgttcgcttttttcaggttgttttctgaagcgcctttgatttcaatgaaccggccgtcaggctttcttctctccggaggcatcgggatgaattgagcccctgacaaataacgtccggtcagagaatccgcatcattcatcacttcttcaggcgtccccgccgatatgacgcggccgccgtgaatgccggcgcccgggccgatatctatcaagtaatcggcagccatcatcgtatcttcatcatgctccacgacaatcagtgtattgccgagatccctcatgtttttcagcgcgctgatcagacggtcattgtcacgctggtgaaggccgatggacggctcatcaagaatgtacaggacgcctgacaaacgggagccgatctgcgtcgcaagcctgatacgctgggcttctccgcctgacagcgttcccgccgccctgctcagcgtcaggtaatcaagaccgactttatctaaaaagctgagacgctccacaatctctcttaaaattaaatcggcaatctgcatatctttctcagacagcgtcaggtttttgaaaaattccagcgcatcgccgacggaaagctcggtaatggtgccgatgtggcgcccgttgaccaaaacggcaagcgcttctttcttcagccggtagcctttgcacgtcgggcacggcttctgtgacatgtactgctccatctgttcacggatataatcggagcttgtctctttataccgtctctcaatattgcgcagcacaccttcaaattcaatttcattttcgcgcacttgtccgaaatcattctcgtatttaaagtagatccgttcattgccgctgccgtacagcactttatcaagctgatgcttcggcaggtctttgaccggagtctccatatcaatgccgtaatggcggcagaccgcctgaagcagctgcggataatattgtgaactgatcggcgtccacggcgcgatggcgtgttcctttaatgacagttcaggattgggaatgacgagctcagggtccacttccagcttcaaaccgagaccgtcacaagtcgggcaggcgccgaacgggctgttaaacgaaaacagccggggttcaagctccccgatagaaaaaccgcacagcggacaggcgtgatgctcgctgaacatcagctcttcctgaccgatgacatctatcatgacacggccttcccctaagcggagcgcggtttccagtgagtcggaaagccgggcggcaaccccttccttgacgacaatccggtcaatgaccacttcaatggaatgctttttgtttttttcaagttcaatatcgtcggaaagctcggccatttctccgtcaatccgcacccttacgtaaccttgctttctgatttggtcaagcactttgacatgggcgccttttctgcctgagatgatcggcgcaagcacttgaagcttcgtccgctccggatattcaagaatccggtcaaccatctgttcgatcgtttgcgacgtaatttcaatgccgtgctccgggcagtgcggcttcccgactctcgcgtataagagccggagataatcataaatctccgttaccgttccgacggttgaccgcggattgcggcttgtcgttttctgatcaatgctgatcgccggagaaagcccttcgatcgcatcaacgtccggcttatccatctgccctaaaaattggcgcgcataggcagaaagcgattcaacataccgcctctgtccttccgcgtaaatggtgtcaaaggcaagggatgattttcccgatccggacagccccgtcacgacgacgagctgatcccggggaatcgttacatcaatgttttttaaattgtgcgcccttgcgcctttcacctcgatccggtcaattgccatgtgttcatcatccttccgctttaagctctaacagtaaatcacgaagctctgccgcccgctcgaaatcaagcgctctggccgcttctttcatttcgtgctccatttgctcaacgactttctggcgttctttcttcgtcatcttcgccagtttaggcgcggcttttgttttatattcttctttatcctcagcggcctgcgtcgcgcggatcacatcgcggatttccttattgatcgtttgcggcgtaatgccgtgaatttcgttaaagcgctcctgctgttcccggcggcgcttcgtttcattaatcgcgatttccatcgaattcgtgattttatcggcatacatgatgacgcggccttccgcgtttctggccgcccgtccgatcgtctgaatcagcgaacgttcagaacggaggaagccttctttatccgcatcgagaatggcgacaagtgacacttccggaatatcaagcccttccctcagcaggttgatgccgattaacacatcatgttttccgaggcggagatcacggatgatttcaatccgttcaagcgtcttaatctcggaatgcagataattgaccttgatgccgatttctttgagataatcggtcagatcctctgacatttttttcgttaaagtcgtcacgagaacgcgttcattccgttcaatcctcgcctgaatctcgccgatcagatcatcaatctgtccttcgatcggacggacgtcaatgaggggatcgaggagtcccgtcggtctgatgatctgctcgatcatttccggcgtatgctcaatttcatacggtcccggagtcgccgacacgtacacgatattgtgcatatgcttttcaaattcctcgaatcggagcggacggttgtcaagcgctgacggcaggcggaacccgtgatcgacaagcacctgttttctcgcctggtcaccgttgaacatgccgcgcacctgcggaatcgtcacatgtgattcatcaacgacaatcataaaatcgtccggaaaataatcaagcagcgtatacggcgtagaaccaggaggacggagcgtcaaatgtcttgaatagttctcgatccctgagcaaaaacccatttcccgcatcatttcaagatcatacctcgtccgctgctcaagccgctgcgcttcaaggagcttgccgttttcgcgcatcactttcaagcgctcctcaagctcctgttcaatattcagaatcgctttttccatcttttccgcccgggtgacgaagtgggaagccgggaaaatcgcgacatggtcacggtcgccgagaatttctccggtcaaagcgtcgacctctctgatccgctcaatttcgtctccgaaaaattccactctgatacaatgttcgtcacgggaagccgggaagatttccacaacgtctccgcgcacgcggaacgtcccgcgctgaaagtcgatatcattgcgggcatactggatatccacaagctttctcagaagctcgttccgctcaatctccatttccggtctgagcgacacgaccatttcccggtattcttcaggcgaaccgaggccgtatatgcatgacacactcgcgataataatgacatctctccgttcaaacagagaggatgtcgcggaatgtctcagtttatcaatttcatcattaatgcttgcgtctttctctataaaagtatccgtttgaggcacgtacgcctccggctgatagtaatcgtaatagctgacaaaatactcgacagcgttgttcgggaaaaactccttaaactcgctgtacagctgtccggcaagggttttgttatgggcaatgaccagtgtcggtttgttcacttctttaatcagattggacacggtaaaggttttgcccgtccctgtcgcacccaggagagtctggtgttttctgccttcctgtatgcctttgacaagcttctcaatcgcttgcggctgatctccctggggctgatatttcgagactaactcaaaacgatctttcacaaaaaagcctccgtttctttacgaaatcttcctattgatatagtaacacaatgacgggcaaaatcactaaaaatacgaactaaagttcgatggtttatttttaccaagtcaatttttgtataaaaaacctgcttttatggcgtaaaagcaggcattctatttcatattcaccatgtcaggcattgtctttctttttgtctgcttcttttttggccatgtacagccctccggccaccagcgatacgacatccaatccaacgataaaatacgtttcggtgtaaccctttaaataggatgcgaaaagcagtgcggctgtgagagcgatcgccacatagtggttaaacgtgacgcgcgtaaaaaggacgaccagcataaaagggaaacataatgcaaaaacggcttttgtaatcacaaaaaccctcctcgggaattcttcatctcatctgattatagtaaaaaatgaagaatcggacaatcgttcccctgctatcacaataccctttttcggcagtcttcaatcatctgtcaaagaaaatgtgaatataaatccattgaaccattaaccagatgaatcgaattacctttcttcagccgaaaggatgagaaggtttaggtctttgtatctttgacagtttcttcctccctctttacaatgtaatgatagtgtttactatcattttcttggatgaagaaaaaaagggggtcataccgcatgtattcagtgcgatttcaaaaagcggaagaatcgagccgctctgcaggagcaaaaggaatgaacctgattaaactgacgaaaaacgggctgcccgttcccggcggttttatcattcagacgaatgccctgacacgttttatggaagacaacgggcttcaagcagatcaggaacagctggagcgcgccattatgaacggcacgttttcaaaagagcttcgggaggagctgaccgcatcgttttatgaattgagagaatcatacgcctctgtcgccgtacgttcctcctccgcgtccgaagatcttgaaggcgcttctttcgcgggacagtacgaaacctatttaaatatcaaaactgaagaagagtttctcggaaaagtgaaagagtgctgggcttccttcttctcggcgcgggtcagcggttataaagagaaaatgaacaatgacaccgcagaaccgttaatgggcgttgtcgtgcaaggtttgatcaattccgaggtttcaggagtcattttcagccgcaaccccgtcacacatgatgacggagaactgatgatcagcgcgagctacggcctcggagaagcaatcgtctccggcagcgtgacgcccgacacatttatcgtcaataaagacacatttcagattgaaaaagaaatcggcttaaaagaaatgtatatcgtctctaaagacgaaggcgtgacggaaaaagagacgtccgctgacatgagaaaccgcttctgccttgatgacgagagcgtcaaagagcttgccatgctgacgataaagacggaggaactgtacggttatcccgtggatctcgaattcggatttgccgaaaataagctctatctgcttcaggccagaccgattacaacgatcgcgcaggatcagaaagcggcagacgaagaacgggaatttatcatgacgccccgggatcagaaagatttttggctcaatatggagtccaatatagaaggtcccgtcagcccgttattcgcttcactcattgtgccggctttggaatacggtctcaaagagagcacgaaggccttccctgtgatgggcatcgagattgagcgtgtcaaacttcatcagggccatgttttttccagacagcataagacggacgacaagctgcccgcagaacagttagaagcgcttttccccgtcttggctgaccgcatgtacaatattattcaggaaacctttctgcctttttatcaaaagctggacgaactggcgcatacagaccatacgccggagactgccattgatgcgttccgaaacctgcaagacttctatttaaaaggatacgcagaacatttcaatattgtctttccgcaggttgcgttaaacatgatactggaatctatgtacggacaggttgagaaagaaaacacctcccttctgtatgaaatgctggccggcgtcatgaataagtcattggagaccgacagacagctctggctgctttccggacaagtaaaagacagccctgagctgcggcgcgtctttacggtttctcatgccgatgagctgcatcagacgcttctgcaatcaaatgagggaaaacgctttcttgaacaagtcggcgaatttttacaggaatacggctggagatccgtgaaaagtcatgatctcattgaagaaacttgggcggaaaacccttatttcgctttggccaacattcagaactatgtccgaaacggatacgattttgacagtgagtttcataaaacgatagaaaaacgaaaacagctctacgccgactttatggatagaattgaagatgacggcttccgggagacgtttgaccgctattatcagtggacattgtcttcatccgtcatcaaagatgatcaccatttttatattgatgcgatgctggacgccaaagcgcgcctttgccttctgaaaatcggcgagctgcttcaaaaacaaggcgtaattgatgatcgggaggatatgtggtacttatacagcgatgaagtcgagaaagcgctggcgtcgccggttccgatgcaggaaaaagccgctgaacgaaaacggctcttcaagcaatatcaattgcttgaagcccccgcttatctcgggactccgacttcggaacagctgaaaacggctgaacagattaccggctccatcacagaagatgaaaaaaacactgaacatcaaatttacggacttgcagcgtcaagcggaatcgcaagcggaccggtgaaagtcattcgtgacgcaagtgaattttcccgtttttcaacaggagacgtgcttgtctgcaaaatgacgacaccgctttggaccagtctgttccaggatgcaaaggccgtcattacggacacgggcggcatcctgtcacatgcggcgatcatcgcgagagaatacgggctcccggccgttctcggcacacgtgccgcgactgacaggctcaacgacggagatatcgtcacggtagacgggacaaacggcaagattacaattgtcaaacgcgcttcatgctaggtttccctctttattgacgggcagggcgggtgtatacttgtcctgccagtatttacgcgaggtgaaacatgttgagaacgacgaacaagagaattattgacgccgcgatgaatctgatcatccaaaaaggataccgcgcagcgacaacaaaggaaatcgcagaaaaagcaaaagtaagcgaagcaacgattttccgtaattttaaaaacaaacaaggattaatgaaagccatgattgaacagcaggcgccggttccggaaagcatgatcaccaaggcggaaggcgatctgtatgaggatcttcttcatttcgccacgacccttctgcagcaattggaacaaaaaaaagaagtgttccgcatctgcctgcgcgaaccggaactattcgaagacgtcctgcaggatattgtcgtatatccgcaatccgtgaaaaagcatttaatcgtttactttaaggagctgacaaagaaaaatatgataagccccggcagcgaagaagctaatgcagacgtctttatgacgatgattttcggttattttatacaccggctgcagctggggaaaagagtcattactctctctgaggaaacgatgctgaaacacagcactgagattttcatgaaaggcattaccggccggtcattttccggctccaaggaggatgaaggatgggttcaaagaaagaatgggcgctgatcgtttcgcttttgctgggagccatactcgttcccatcaattctacgatgatcgcagtcgccctttcatccatttcccgctcattcagcgaatcaattgccagcatcacatgggtagtgaccgtgtatttaatcgtgatggccgtgacacagcccattgccggcaaactcggtgatatgtacggaaacaaaaaaatgtatttatggggcgtcggcctttttctcatcgcatcattggggtgcgccctctcgccaagtcttttcttattgattttcttccgggcgcttcaggctgccggcggcgctttgcttacgccaaacagcatcgccatcatccgccatgtcgtgtctgaaaaacggcttccgaaagtattcggctttttcggcctcggcgccgggctgggcgcagctctcggtccgtttatcggctctctattaattgagagcttcagctggcattcgatcttttgggtcaacattccgtttcttgcgatcgcactcgtgacggcattaatgatgtttcctaaatataaagaagaaacgtctgacgctccgcttgatatcatcgggtccgttttgcttgccggaagcattgtatctattattcttctgacgaaaaatgaaagctctttgggctattgggtgtacgcgctgctcattctcgtattggttccgctatttttcaggcgggaactgcgcacgaaacatccgattattgattttgacctgtttaaaaacacgacctttacgagcgccaatctgtcggttctgttaagcaatttaatgatgtacgccgtgttattgattatgccgctctttatgaccggccacttcagcatgaacacgtcgcacagcggcatggcgctgtcagtcttttctgttttcatgtccgccagcaactggggcggagctcagctgcatcagaaatggggcgcgcgaagaatgatttttctgtccttcgggctgatggccgcagccaatctcttatttctgcttttggtttattcccattccgttccgtttcttatggcatcgcttattgtaggaggcatcgcgtcaggtgcggggctgacgagcatgcaggtatcttctcttgcgacggtagaaccgggcatgtccggcatcgcatccgggattttctccaccttccgttatttcggaagcattatttcttcagcactgatcggtttaatctccgggtttcatattctgtttatcatattgatcggagtttctgtgatcggcttgttcgtatcgcttggaattaagtccggggaaaccgttcagacgaaaaaaagccattcggcataacgaaaaaggttccgtaagcatcagctttccggaaccttttctagttttccttcttcattttctctctcaaagtgtcaccgcaatgccgtttgctctataagaatcttttgatttacaagagaaaaggggaatgtaaatggctgagagttccgatcaagttcggcgctgacatcgtaatccggccgtaaaaagcccggccgccgtcttttattttatttatttcactcactcctatgttcaacttgagcccactatcattactatataaacctataagtattcaagatacatttaattgtacttctctatctcgctgctctgccagcaacaaattcaccatatcactatagctattcaaaccgtctgtctgattatttgccttcagatatacatcatttacatttcttgaaatacttgaaataacaccctcatacttatcccggtactgctcattttgttctatatcatgctgcaccgccttggacagactggacattatatcagacgcctgatctggatccactttctttagctcagatatagaataaacaaatgctagaaaaaaaccactgtaaagtatcattggatcatcctgctgcttacatgccagatatgctataaaatttgcctcatcctcatgcatgaaaccactctgatgtgccaattcatgtgccatagtagcaggcaccaagaaaacgggcacattaacattgatattggattcataagtaaaagggacaaagatgccatttatccctgcatgcgacattagctttgacatcacaactggttttggtgttgagtataaagaatgctccaaaataggatattcctttgataacatttgcatcgagaacactgcgtgttgtgcataataatcaaaaacctctggtacttgagccaaaagatcagtgtccgctaacttttcccttgccaattccatttcaacggcaagcgacttactcaatttgaccagttcctccttgctgtagttctcttctttatattcggtataagacaaaaaagaatatctgtaatagtttattccacccaaaatagtataacaaaaatatatcacgctacagatcgtaactattcctagagcaccacgataaactaccatcctacgtacacctttactcatgataaccttgcgcacataataaacgatataaaatagaaaaagtaacacaaccaacacgacgagccattcactaacagaaaacttgacccaagaaggtacaaatcctactatttttgacaataacggatatacagacctactgtatttttccgcccaatcctgatggttctgcgcgtattttgtcagtatgtaagctataactccaagtgaaatcaacggtaatctcttaagtaaaagcttttttataatgtactccccctatccaacataaccattataatcagttattcttaatatatatcctgctaaagattcatcttctaaaggttttggagttagcaataacctttccaataagccatacctctccttcatttatttttttattatttcaaaataaaacagctaagaaaatataattttcttagctgttttactttctaactgattttgaaatctagtttaggagttcttgaaactattccgaataattatgaaaaatcacattataatgctgtcatttcttcgtgctcgtgttcatcctgcacgaataaaatacctaattcatgatgttcgccttcataggacgcgcgctgatcaaaacggatctcaccgttcaggccgatgatctccatttttacaaatgcgcggtttttttgaagtgcttcataaaaatccgatacatgtttcacggggatgccgtttactttcgtaataatctcaccgatcttcagctcaagatcgtccgcgggtgtattcggaatgatgccgagcaccattaagccctgatcccgcttagagaaataaaacggagccgcgttatcgttcagccgctgtctcaatgataaaaacaggcgtccgagcaccgcaatacaagcggcagctccggcaagcggagtccaccaaagggcagctgccccgaatgcggtcacgataaccccgagaatcatgacacgtttcgccgttatccttatgctgacttccggaagtgacccctgcacacgctgtccgaagccggcgatataaggaatccagatcaaatggaaagagccgcccggtacggtaaagacaggccaccaagaaaggtgtgactcaagcccgctgcccggcaccaataagaaaagcggaagcagccatgcgcgattcgccaattgtcggccgatgggcaggcctctgctgctgacgacaagcgccggagatgttttcagatgcgctgaacggcaggcagccgctccctccgtgataatcaaaaggcccataaacacggccgccgatgcccaattcacgccgaatgcctgcggaaaccgatccgcaaacggcactgtgtgggtatactgaaggataaacgcaatgaacatgccggcgctgacaatataagctgaggacagccaattcatacggaacgtcagcgaaagcaaagcagtcacagccgcgattatgccgagaagaccgaatggaatcgaaattccaagtccaaaaaataatatggagagaagaatacccggtataagtccttttatgtatgtaaagataagctcgtcatacatatccgcgatctttgtatgaaacgtatggcgttcacgtttgatccgcaaatatccgcatgcgagacttatgatgataaaaaaccagaacatcgggtgcaaaaaaaacagaccgatacttttcagaagttcaattccccattgaacagacactgctttcaccgcctcaagccaaacattttaattctattctaccaaataatcattggcttgaatatctcaaacgtctatctctcttccgtcatccacaacgttacatttgagagagagaaatctttcagatagtggtcaacctccacctcgatcacgccgctgatcagaagcatggaccgcttaatatccgtcagattgattcctaaacgtttatggtttttcattaagtaagtgaaataatgcttcgcacactcttcattgatttcgtgaacgcattcaacatttgtgtaattgaccaggtatctgctgaacagcataagaagacttagtgcttttgttgatgaaaatgtgacgtcttttgttctgtcttttagttgttccactaattcataatattttttttcacgcacaatacttgccctcttcaattgtgaacccccatttttttatccagataagcacgggtgattacagctgccgtgctgaagcgccgcaaacacttctgctttcgatactgaaatgcagctgccaaactaaaactgttctctattagaaccttcttttattgtaagaactaaaactgactgaggcaactttcaaaagtttcattttgaatacatattaaatcggcataaagtctctcttctctataaatatcgggtaatgtttgtcctttataaatgtttaaatgtgaaaatttttttaatatcttgtcaaaaccgtcataattatatgtcttttggttcactttttatgaatgacaaaagaaacaggagacgcaaaaaacgcctccttttcatttattttacaaataatgattttaacgccatttgcagctgcaaatcatttttttcgtcagatttcttttcattcatcagctgattcattttttccgctgtctttttatcaatgaccgctgttttatcaagcttgtaccggtcttgaaacgccagaacggcttttttcattgttttgctgaaatagccgtccgctctgcccgggtcgaagcctaggcctttcagcaggatttgggcgtgcttgacatccgcgctgttcatatcaggctgaagcggctgtttcagctgaagcggtcccgccgcaaaataatccggctggctcacagcgattgtcggagcaatgccttttttgtgaatccaattgcccttcggtgtcagccatttgtaaagcgtcaatttaatgttgctcccgtctcccataggcacggcctgctgaaccgttcctttaccgaaagaagtgtcgccgacaacgtcataatgtcccgcttcttttaacgcgcccgcaagaatttctgaagcggaggcgcttcctttatccgtaatgacattgacgggatacggcttcttatgttttaaggttgagaaatattgttttttatcgccgttacgctccgcaatttggatatacggcatgtcttttgtgatgaaatgctttaaaatttgttcgacgctttgaaggtagccgccgggattcccccttacatcaaggacgagaccgtcaatcccttgtttttcaagctttttcagcgccgcggcgaagtcctcggcggtatgctcggaaaatgtcgatatgccgatgtagccgacatgatgaccgcctgattctttgcgggaagcaaatacggtttcaagcgggatttccgctcttttaatccggaatgacagctgtttttcagtacccggacgctgtattttaatagaaaccttcgatcctttttttcctctgattttcagcacggcttcgtttatatctttcccgttcattgacacgccgtttatactgatgatttcatcattcggcttgaggcccgctttttctgccggagattgcttaaacggtgatacgataatgattttattgtctttcataccgacttcagcgccgatcccttcgaaagaagaatcaagagaatcggaaaactgcttagcggtctgcttgtccatataaacggaataagggtcgtttaatgtagacagcatcccctgaatcgctccttcaagaagcttttctttatctacattttccacgtattcgttcgagatcagctcatatgctttttcgattttttccattgcccgggttctttctgcgtctgatgaattcggctgtgccgccccggcaatatgggctccgccgcacatcatgcttagggccgctatcactgcgatcattttctgcttcatcgtttacctcctcttagtcctttaacgaaaacctggagatagtatgtgtaaattgcaaagaattcatgtaacggcaacaaaaaaatgaaaaagcgagattgtttcatatatatgggtaacgtataatattttgtatgcaattcattaaatatacaggagaatgcgatatgaaaataaaattatcgattttatccgcggcggttctggccgcaggcattaccgcctttgtctggccaaaaacagaggccaatgagaaagcgcagacggacgccttgtatgtttctcccgcaggcagcgaccaatatgaaggaacgaaagaaaagccgttccgcacattaaaacatgcggctgaaaaggcagaggccggaacaaccgtattgattcgggaagggacgtacgatgaaacgtttgaagtaaagcacagcggcacggccgaaaagccgattacatttcggaactatcagaatgagcatgtctcaatcagcggcaaatctgcgccaaaaagcgattctgaaactccgttaattcaaatccgcaataaacagtacattaccattcacggcgttacgcttgagaatctctccgtatcatcagaagatgcgacggccatggggatctgcgtcaccggatcaagcagtcatatcaacattgacggcaaccatatccggaacattaaaaccacggctgatgaaggaaatgcacacggcatcgcattttacggcacaggtgccatgaaggatgtcagcattacaaataatacggttgaaaaactgacgctcggcgcaagcgaagcggtcgtgctgaacgggaatgtcgacggatttaagattgccggcaataccatccgggacaataacaatatcgggattgacgtgatcggatacgaaggaacgtccaagcaaaacgactatgcgcgaaacggcgtcattgaaaacaatacggtgagccataactcttcttacggaaatcccgcttacggagatgaatattcagcgggcggtatttacgttgacggcgcagaacatgtggacattaagaaaaacaccgtttacaacaatgaccttgggattgaagccacctctgagcataaagggaaatacgcacgagatatccggattacggataacaaggtgtacggcaatgcatacaccggtatttcaatcggaggctatgacacgaaacgcggcggcaccatcaattcggtgatcgctcacaacatcatgtaccgaaatgacacgaaggaccttgacggcggccagctgctcctgcagtacggcacaaaagggaacacgatcgaaaaaaacatcatgacggcaagcgattcacggatttttatcgcaaatgattttacgaaaaacgaagaaaataccgttaatcataacgtctatcacaaagaagagggaaaagacggcatctggaattggaagaacagagaatatgattcattcacagcgtaccgaaaaggaacggcaaacgattcggattccatttatgcggacccgatgtaccgtgacgaatcgtcttatgactttacattaaagcccggatcaccggccctgcccgtcattcagtaacgaaaccattaaaaaaagccagtctgtatcagactggcttttttatttatacacgaaggaatttccggatggaagtcagacttccccatactccgatcaccgcgccgatcagaatgagcacaagtgatacttgaaacacaaacggactgtacggcagaagtgaaacaaatgatccctgaactttcggggccacccaagcgaccatcgactggtacgtactcagcacgagagcgatcggtatgacagaaccgaatacccccagcagcagcccttccaggaagaacggccagcggataaaccagtttgtcgcgccgacaagcttcatgatttcaatctcttttcttctggcgaaaatcgtgattttaatcgtattcgaaattaagaacatcgccgtgaacagaaggccgatgattaacgcaatcccgatgttgcgtgacaccccgacgatcttaaacagacggctgacttcttctttcccgtatgtcactttatacacatgatcaagcttctcaatttttttcgcaactttcggcgtatcatgcggatctgtcgttttgacgataaacgcgttgttcagcgggttttcctgatcttgcattttcatggcctttccgctgtcgccgaagcttttgaccaattgatcaagctctttatctttagatgaaaactctacgctttggattcctgaaatgtcttttatctcattctgcagcgtatcctgcgttttcttatttgacgtcagatcgattaatactttaatttccacttctttttcagcatttttagccatgttgtttaaattcagcataatgactaaaaacacgccgaccaaaatcaatgtaacggtaacggcactgatggatgcaaatgtcatccacgtgtttcttccgagagatttaaaactctcacgcaaatggcgcccgagaattttaatcataagaaccatactcccctcttgactcatcacgcacaataattccgtcttcgatcgcgatgacccgtttcttcatggtgtttactatttctttattgtgtgtcgccatcacgacggtcgttccgcggttattaatctcttccagcgtcttcatcacttcccatgatgttaccggatcaaggttgcccgtcggttcgtcagctatcacgacgtcaggattgttgacgatggatcttgcgatggaaacacgctgctgttctcctccggaaagctggtcgggaaactgccgcgctttatgcttcagctgcacaagatcgagcacttcgagcacgcgttttttaatgactgactgctgctctccgataacctcaagcgcaaacgctacgttttcaaataccgtcaatttaggaaggagtttgaaatcctggaaaacaacacctattttacgccgcacgaaaggaatctctttttctttcacagccgcgagatctttatgattaatcaatatttgcccttttgtcggtttttcttctctgtaaatcattttaataaaagtagatttaccggctccgctcggtcctacgacatatacaaattccccgggatgaatcatgactgacagcccgttaatcgcttttacaccgttcggataggatttatatacttctttcatctctatcatgaaatcacctaatcttttatttatgtcttgcagccatagagttcgcaaacatacagcggtttatggccgattcgtcaggaaacagatgaaaaatctgaaagttccttttcctcagtacacttcattatacgtcaaatttagacatattactattacagtttcttttcattcccagaccgagaaaaaaccttgcccctataacaggcaaggtttttctgttattttttctgtgacagccattttgcgatcttcacggcttcctcatcatttacaagatggctcggcatattgccgcgtccgtttttaatgatgctttcaattttagcttcatcatacttcccgccgacttcctgtaaattcggacctccgccgccttctaggtctttaccgtgacagccgatacagctttgctgataaagttcttcacccgctgacgcagatgcttttgatccgcctgagctgtcagagctttcttttttcgattcattggatccgccgcatgccgccagcaggacggacatggtcagaaccagcgccagcagcgcccattttgatttcatatgtaagatgcaccccttcgctattataacctcgtttacgcgcgtttgaaaccctcgccgagcacctcgcttgcgtctgcgacaatgacaaaggctgactcatcaatttgtttgacgatttgtttcagttttgtgaattcggtctgaccgacgacacacattaagatcggccggtcatgttccgtatacccgccgactgcggaaatcttcgtcacacccctgtcgatttctttaaacacagctgatctgacggcttcttcatgctgcgtaatgattaaagccattttggagcggttgaacccgacctgcacgacatcaatcgttttgcttgaaataaataccccgagcatcgcatacagtccctgctccactccgaaaacgagcatcgcgctcagcacaattaatccgtccatgatggcaaggcacgttcccagcgacagccccgtgtatttgtgaatgatctgcgccgccagagccgttccccccgtggagcctttgccgagatacacgatgccgattcccgttccgatcccgacgcctccgaaaatcgccgccagcagttcatgggtcgtcgcggcaggcagatctcttgttaaaaagacggcaagcggcagaacgatggaaccgaccagtgtcttcattccgaacttcccgccgagaatgatcactccggcgataaacaaagggatgttaataatccactgcacataagccggttcaaaaccaaacgtttctaaaatggtgctgatcccgcttactccccccgctgctatacggttcggcagcaaaaatacgttaaacacgacccccgtaatcgccgcgccgatcatgatatatatgtaatctttgatcagacggagcggcttattgtgattcacatccatgcaaaatcctccgttctccgattttctctcgatagcattttaagtcttcccggcttagaagtaaataacagccaaataccgtattaatttgctaaagcgctgttgtgaaaaatggaaaaagagaacggataaaaaaacacaccttgccaaaggcaggtgtgttcccggattacgacagtttagaacgtaaataggcgtcaatgaagatatcgatatctccgtccataaccgcctgcacgttccccatttccgtattggtgcggtggtctttcaccatggagtacggatggaagacgtacgagcggatttggctgccccagccgatttctttctgttcgccgcggatttcgtcaagctccgcctgctgttcttcaattctgcgctgatacagcttcgctttgagcattttcatcgcccggtcgcggtttttgatttgggagcgttccgtctggcatgtgacgactacatttgtcggcaggtgggtgatccgaacggctgaatcagtcgtattgacgtgctgtccgccggcaccgctcgcccggtacgtatcaactttaatatcttcggtacgaatatcaatgtcgatttcttcattgaattcaggcatgacttcacatgacacgaatgacgtgtgacggcggcctgatgaatcaaatggagaaatccgcacgaggcggtgtacgcctttttccgcttttaaatagccgtatgcattgtggcctttaataagcagtgtgactgacttaattcctgcttcatctcccgggagataatcaagcgtttcaactttgaagccgcgtctttccgcccagcgggtatacattctgagcagcatggaaccccagtcctgggattccgtaccgccggcgcccgggtgaagttctaaaatcgcgttatttttgtcatatggttcactgagcagcagctgaagctcaaattcattcaattccttcgttaatgacttcagctctttttcaagctcttgctgaaggtcctggtcaggttcttcttttaaaagatcatgtgtcatttgcagctcttcgtgagactcgctcagctgatggtaggagttcacgtattctttcagaccgttcgcttcgttgatgacggtttgggccttctgctggtcattccagaattccggttccgccatcttttcatctaattctgcaatgcgggcttcctttgattcgaggtcaaagagaccccctgaagtccgctaaacgagaagccatattttcgagctctgccctgatttctgataattccattccattcacctcattaaaagatccggggcgccataagacgcagacccggtcatgttcgcttcatacagtcgagactattctgtccggccgcagcaatttttatatttttttccgcttccgcaatggcaaggcgcgttgcgtccgatatccacaaccttgcggaccggcgcttttttcgcttgtttggcctcatcgccgtcctgcggctgatgagccgtcgtttggccctgaacaacttcttcgcgttccagattgctttcaatctcggccttcatgacgaatttcgcaacttcgtcctcaatggactcaatcatgtgctcaaacattgcgaagccttccatttgatattcacgcagcggatttgtctgcgcataagcgcgaaggtgaatcccttgacgcagctgatccatcgcatcaatatgatccatccattttgaatcaacggcacgcaatacgatgactttttcaaattcacgcatctgctctgtaccgaaattctcttctttttcattatattttgtcatgatgcggtccatgatcatctcatgcatttcatccggttcttttccgaagatatcgctcttttcaagcgcgccttcatcaagatacgttgaattcaccagctccacgaggccgtcaagattccattcttccggaagctcctctttcggcgtataagcggcaatcgcacgctccagagaagacttgatcatgccttccacaatgtcgcgcaggttttcagagtcaatgacttcaaaacgctgcttgtaaatgacttcgcgctgctgacggagcacgtcgtcatattgaagaagctgtttacgtgaatcgaagttgtttccttcgacacgtttttgagatgattccacggcgcgtgacaccattttgctctgaatcggcgtggagtcatccataccgaaccggtcaagcatcgccatcgtccgttcagctccgaaacggcgcatcaattcatcttccattgaaagataaaattgtgtgatgcccgggtctccctgacgtcctgaacgtccgcggagctgattgtcaatccggcgggattcgtggcgttccgtaccgacgaccgcaagaccgccaagctcttttacgccttcgccgagtttaatgtcggttccgcgtcccgccatgttggtcgcaatcgtgacagcgcctttttgtcccgcttcttcaataatctgagcttcacgctcatggtttttggcattcagtacctggtgcggaatccctttattcttcagaagtttagaaatcaattcagacgtttcaacggcaaccgtaccgacaagaaccggctgtccggtcatgtagcgctgggcgacatcctccgccaccgccttgaatttcccttccattgagcggtagatcaagtccggacggtcgtcacggatgaccggctggttggtcgggatggatacaacctgcatgttataaatattgcggaattcttcctcttccgtttttgcggtaccggtcataccggccagcttctcgtacatacggaaatagttttggaacgtaatcgtcgccaatgtcatactttcattttgaatctccaggccctctttcgcctcaatcgcctggtgaagaccttcgctgtagcggcgtcctttcatcagacggccggtgaaggaatcaacgatgacgacctggccgtcctcaacaacataatccacgtctttctgcatcgccgcatgggcttttaaagcctggttgatatggtggttcaaggccacgtttttgacgtcaaacaggttgtcgatgccgaacgttttttcagccttcgtcattccttcttccgtcagctgaacgcctttcgttttgacgtcatacgtataatcctgatctttcttgagcgtgcggacaaacgcatttgcctgcacgtacagttttgtggacttctgagcttgtccggaaataatcaatggcgttctcgcttcatcgactaaaattgaatcgacttcatcaataacggcaaaatgaagcgggcgctgcaccatttgttctttatagagcaccatgttgtcacgcaaataatcaaagccgagttcattgttcgttgaatacgtgatatcggctgcgtaagcttcgcgtttttcgtcttttgacattgaattcaggttcaggccgactgtaagcccgagaaacgcaaagatttctcccatttgctgggcatcacggcttgccagatattcgttgaccgttacgacgtgaacgccttttcccgtcaaggcatttaaatacacgggaagcgtagacgtcagcgttttcccttcccctgttttcatttcggaaatgttcccctcatgaagggcgatgccccccatcagctgcactttaaacgggaacatgccggttacgcggcgggaagcttcacgaacgacggcaaacgcttcgacaagaaggtcatccgtcgtttctcctttttcaagccgctctttaaattctgccgttttatttttaagcgcctcgtcagaaagattttcataatctcctcttacggcatcaatgtcatttgctattttttcgtatttgttcagcgcacgtttggtcggatcaaacattttatttaaaatcccaagcatctataacgctcctctatgttcacatgcagattttgcatggaataaatgataattttctgtccatgtatacctctcattatcataacataccttttgctatttccaaagaatttgcagataaagatagagaaaaaccttccgcgcgttcacggaaggctgggtgggtttattcagtcggttcaattaatccgtatttgccgtcatttctgcggtaaacgacatttgtgagattcgtctccgcgttggtgaatacgaagaaattatgtccgagcatattcatttggagaatcgcttcttcattatccatcggttttaaattaaaacgcttttgacggacaatttccgggctgtcatcttcaatttcgtcctgaaccgctacgcccgtatcagcagcgctgccgttctcgaaataatgtttcggaagaccctgctcgcggaattttcggttgacttttgttttatgctttcggatttgacgttccagcttgtttgttgcgagatcaattgcattgtacatatcctcgttatgcacttcagaacgaagcgccagatcagtcatcggaatggtgacttcaactttggattccttatcgttatagaattttaagttgacgttcacatcggcattgacgctctgctcgaaatatcgttccagcttgccgatttttctctccacatgatcctttaacgcaggtgtaacctcaatgttttctcctctgatattgtagttcatcaaagaacgcctccctttatctaaggatatgtaactatttctcttttaccccttctgatccctgctgaaacgttaaaataatgtgtaaattcggtgaacgatgacgaatggtgtcggttttatccggcagcttccggcaggattataagtatatgcaaaggacgcaggcaaaagacctgccgcttgcagcaggtctagtgaagaacatacggtttgatacagtcgtgcgtctgctccatccatagcttataatgcggcagaaagatggtttttaaaaactcctgaaaaggggcggacgggaaatcataatcatttaacatgctgaaatcctgaaagatctcgtcaaatgagcggatcgccgtctccacgcatcggcactcaatgatagacagcagaagcgcatgagaggaatcgagatgaaaaaaagcctgaatcaaatcgttgtaaatccgctcgccctccgtcttaaaaaaatcatcctgcgtgtccaacaggtagcaaagcccctcatcaatcgtaaaaagaagctggtaataggctgacaccaaatggtaatcgttcaaacttctcaaaacactcacctatttgcgtttgtcgtaataacggccgtcacttgtcgtttgctgatacggattgaaatacgtattatggtagattcgttttttcttaagcgtttttatttcatttcggataccatcctgaatccgtttcacttcgccggtaatcagacggtccatcgcggccacctgctgaagcagcgttttttcttcttcggaaaaaggcggctttatgcccgcaagcatctcctcccttttctccgtaaatgccgtaacgctgctgatgagaccgtcgctttccggggcgtccttcagtgcggcgtacatgttcttcgtttcgttatacaaagaaaagacattgctgttcatcaggcaaggccgcccgcgccatggctgtttttccgttcactctgcatggcctgcttccacgtgtcgcgaaattcagtaacgagcttttccgcttcatctaaaaactctccgttattctgcacgttcgcgtcgatcagccggcggcggatgtaatcataaatggatgacatctgctcggaaatctcaatctcccggtttaacgtgatgctgagctcttgaatgatgttttgcgcctttacgatattttcatttttggcttcaaggttgttttgcttcatcgcctgccttgccagcttaatgaatcgcaggcagccgttataaagcataagggtcagctcttccggagcggctgtaaagacggatgtctgctggtaagcagcaaaaggattatttattgccatttttataaaacccccaaggttatgaagttgaagatcctaacattgacgtgagatatgaagattggctgttcaatttctccaatgccgtatccagtgcgctgaactttttataatatctcgtctcgatgtcatccagcttcgttttcatattggaaatatttgtttctatttcatccaggctttttccgatggcaaagctggttgataccgagctttccgtacccgcctgttttgaaatttgaatctgcattttgtttaatgtgtcttttaatctccgggcaatcccctgttcctccgggtttttggttttcgctgtatcagggctgtctgcattaaacagtttagccacgagagcaggattctcggtaattttctgtttcagtttcgcttcgtctttaatgacaagctttccttgatccgtataactatcagacgtctcaattccgaaatcggcaagctgatattttttcccgtcaatcgtaaccgttgagtacagatcaagccgcatctccgccaaaccgttctgcagcgtgctgtcgctccgtaataaaccgcttttggcttttgcctcccactgctcaatctgcttatcggtcattgcttctctttgttcatcggttagcggcttataatcacggtattttgattctgtcaccttctcatttgcgcttttaattaacgtattgtatttatcaacgaaatctttaatgttgttaaaaatgccgtccgtatcagtcgtgctgttaatcgtaaccgttttgttgctgtccgtcacgctgttcagcgtgtatttgatgccgttgatcgtaaagttatttgacgtttttgtcatttcaagcccgttgaacgtaaacttcgcgtttttcccttcggcattggccgtcagtgcatttgttgcatcatcaacggcaaaaccgagctgatctttcagaaagcttttggtcgcgtcatcacctgctgaaagggtaaacccttcccccgttttattggaagtgaacgcaatcgtgtccacataatccgagccgttagagattttctcttttaaagccgtcactccgagacccgagctgttcagtttagaaatgacatcgtcaatcgtatcggttgcggcgatcgtgacgtttacctcagtcggcttcgtttcccccggatttgtgacattgaatttcaatgtttggctttgacccgaagtgaaattgatggcccctgatgatttataagtcgtcggcgtagccagctgctgtacagacatgctcgttgaaatattctgttcggcactgacggccaccgcgctgacactggaatccgaacttgttactgtttttttattccagtttgtggacatcagcatattattaaatgtagtagaatacatgtcggcaatctgggtattcatttcccgataagcatcgcgcttccattcaagcgtctgcttttgctggtttaatttattaagcggctgcttttcggcatccatcatttttttcaccagagaatctacatcaagaccggaattaaggcctgtgattcttgtgaccatatgtaccctctccttttcggcgtttagtcgtagacggctctatgacaacagtgagtttccgactgtttatcatatcacagctccataaatgtatgatcttattcttatatcggtcatattaaaaggttttcaataatttaactgcaaaatataatgtttcattttgtcaatagggttctttggcttgctgaaggaggagttagctgaagaaataaaaaaaagaccctggagaaccaggatctttccgtcattaacctttaagcaattgaagaacttgctgaggctgttggttagcttgcgcaagcatagcttgagaagcctgagtaaggatgttgtttttcgtgtactccatcatctcagaagccatgtctacgtcacggatacgtgattcagcagaagtcaggttctcagaagaagtaccaaggttgttgattgtgtgctctaaacggttttgaaccgcaccaagtttagcgcgctcgctagatactgtgtcgatagctgttttgattgttgtaagagctgaagacgcagctttagctgaagaagagatgtcgataccttttgttactttagaatctgcagctaatttttcagatgcaataactttaccgtcagtatcataatagccggctgcttttgtaaccttaccatctggatctgttacttcatccgcccaagtagcagtgctttttccgtcagttgatgtcaatgtattttgatcattggatactgtataagtcgtaccaactttcaggctttcagagtccattttattgatagacaggctcattgtttggccttcgttagctccgatttggaacgtcaggttttgcgcagttccgtcaagaagtttcttcgtgttgaactcagtgtcagtagagattcttgttacttcagacgctaattggtccatctctttttgaagctcagaacggtcagaatctgtgtttgtatcgttagctgcttgtgtagcaagctcgctcatacgctgaagaatgctgtgagtttcgttcaatgcaccctcagatgtttggataagagagattccgtcttgagcgtttttagacgccatgtctaaaccgcggatttgagaacgcattttttcagagatcgcaagacccgcagcgtcatcaccagcgcggttgatgcgaagacctgaagataatttttccatgttttttgcagcagagtttgaacctgcattcagctgacggctagtgttaagagccgcgatattgtggttgattctcattttgtatttcctccctgaattgtttttcgcacgtccttgtgcatttgcgcagcgtcatttctgaagaaaatttttcctctcattggctacaatatatatatcggacggccgcttccattgtttatattgaaaataaaaaaatcctcactttttttgtgaggataagttaagtaataaatcagtattaaaagatacggctctgttgttctcttccaggatcgacaagtagatttctttccggtgaatatctacgtgctgaggcgcttcaattcccagcttcacttgttctccttcgatagcgatcacctttatttcaatatccggcccgatctgaatggactcattcacttttcttgagagaactagcatgatcctcctcctatcagatgttttgtttcataggaagcatcatgtaaaatgatttgtttcgccttcatttcctttttattgacgataatcggcgcttttaaattggcggtcgtgttttcaaaaggctcttccagcgttaaaatcgccatcacttcgacgtcctctatatcttcaatatgcaaaagctcaagcgtcgcttggtcaatgtcaaattcgtaccctttaaagaaaataaacggactggcgacaataaaggcgatgtgctcctgtttcacagactgcagcgccaaaaacggtgaatcttccgacaaaggaagaacaacaaattgagtctcgtcattaaatcccggcaggccgttttcaaatgagataatctgcccttcatctattctgatttctccgtgatattttgttttaattatcatccttcacaatcctttaccactttcatcttttattctgcgttgccatcatcaaccgaaatcgtcaccttagggtcttgcatcatatcaatctgaactttccccggcgtataattccatacaggtttattgacagctgcttcaattgaaggtttgcgggcttcaatatcaatcgtaagctttgaaggaatgcagtcaatgtcgacgagaaactgcgcaggcagaaagtcgctgaattcgccgaatggatcgggcggactgacatctgctgcctgccgggccatcacattgcccgttttcttttcgatagccgccatttccttcccttccctgactgtttttgcgataaactcgctgcaggcttccgcacctttttgagcggcttcagcgttcagcttttcaaatgatttgagattcaagttctcccacgccctcgtctggtcaatcgtcagtttggccggcgtgctttcgatgttcagctctgccggcggctgctcgatttccaggtcagcgggcggctgttccatctcgatttcttccttttgaaaggttataccgattttagcaggcacactgtcaataatcaatctcggcatctgcacagagatccctcctgtttatagtattttagtaaaaaaagcgatctccctgttgtgagtcgctttttttatatattgaagacgatagttatattatttcaggaagtcgatcagtgacggctgaatgatattcgcattcactgacagcgctgctctatgaaccgtctgttgagataaataatcaacaattacatcttccatttctacatcctcattatccgacaatactttttcagcggttgccgcttgtgattccaatcttgtctgaatgagttccaaccggtttgtgcgtgcgccgatattggatttttcagcattcattttgtcagtaaaaccgtcgatatctgacagaatttgatttgaatctgcttcggacagcgtgcctttgcttaaagaagcttctaaggagttgagaaattcaaatacattatctccattttgtgcgacgcctccgaaagctgagtttggatcagaattcactttcagcactgctccgtttgagatgttgatgttaacatccgaagcaccggtataattctcatagttgtacgtatatgtgccgtcggcattttcagtgatcggcgggacatctgaattcgttccgttaaacagataacgtccgtttacctgagtattcgcgacagaaacgagctgctttttcagctggccgatttctgtaccgattgctttcaattctgtttcaccgttcgaatcacttttcgcctgaaccatcaagtcccggattttccccataatatccgtttccgagtttacgcttgattccgagttttccagccatgtaaaaccttgcgaaacattccgttggtactggtttacctgcgcaagctgagtacggtactgcattcccttcattgcgacgaccggatcatcagaagctttcgtgatttttttccccgtagacacttgctgctgaagccgatcgagcttgtcataacttgagccgataaatcgaagagaattttttgcgatcatcccttgagttactctcatttacttatctcctatcttcctccggtgcccataccgttaataattttatcgaatatttcatcctgcatcgttatgatccgcgcagccgcattataagcgtgctgaaactgaatcatatttgtcatttcttcatctaaagacactgcactgactgattgtctccgttcatcggctgaaagggtgttgctttcagagttgttcataagattagccgctttttgtgaattaacgcccagctttccgataagggattcataaaagtcattaattgtagtggtttcaccgttaatagtcagcttgctgttctgtacggctgcaagatttgtcgcgtttgtgccgtcacttttttctccgtttaacgacgctgcgatattatcagtagacgcaaggattttgtcactgacttttattttcgctgccgcaccttttgccggcaccgcttcatcaccgctgaaatcaaaaaatgctgcaccctgttcgcctgtataggtcttccctttttcatgaactgcattaaacgcgtcagcaaaggatagcgccatattgtcaagagccgtcagcatttcaggataaagccctttttcttctccgtttgacatatagccgtatgattcaataagacctaaaagtgagccttttccggtaaatgcatccgcattgaccgtactgctgccgactgacacactcgacacgagtccgctgtccttgtcgtagttgattttcatttctgaaactgtttttgtgttaccgtcgagcagcgttccgagagaattgttgttcccgttcagcaattcgacgttaaccgtgccctcagcagtcgccaaggcatgtccgcccgacttattatatgaaacttttatatttgccatagaagataattgatcaatcaatctgtctctttggtcatacaaatcattagggagcataccgctcggctcaactgccgctatttgattgttaaggtcattcagctgattgagaatggaattgacctgatcagctgtgttatccaggttctttttaatatcaccctgaatgttagtcaaagaggtagatatatagttaaaactttcggcaagagatttcccctgctcctgcaaaactgagcgcgctcccgtattttccggattcgtcgccagatcctgaagggcattccaaaatgaactgagcgatccgtttaatccgttattgtcaagctctttcatgacgccttccatttgcgacaatgaattggaacgggctgtatagtaccctaattttgtattttccgttctgtactgatagtctaaaaaactgtctctgacgcgctcaactgaaccggcttttactcctgttccgatttggccggccgtcagatcactgttttttgatactgcgggataagggctcgtcgattgtaatgtgacgcgctgcctcgtatatccttctgtatttgcatttgcaacgttatttgaaactgtgctcaatgcagtctgctgcgcactcaatgcacgccttgctgtttcgagccccataaaagtcgatggcattgaaaatcctccgttctaagcttttgaatcgaataatgtcaaacggctgacaggcttgcgcgccgcttgcggctctttataattcatattctctttttcacccggcatgatcatatcgaatgccccggagatgaattgtaaagcctgaatcgtgagctgtttgttcatctcattcacttctttcagacggtcaagaagcgcagacagagagtgaaataacccttcaagctcctgtttttcactgcctgaagttctggagatgcatgcagcaattgtattgtcctcaccgcggctgagaaactgagaagttaacctgattcgttcttcctcagtctgcccgattgcctgaatatacttttgctctttagtcaatatgttggagagctcttttgttttacctgctttcagcgcttccgttttctcctcagacagcgtgagcagatgttcatgcagtgcgcaaagtcgcttcagttgatcaataattggctttgcagacattgactttctcctttttattgctttttataaaaattcactatgttttcagcgatgctgtttgaatctattttatatgttccgctctctatatccgctttaagctgagcgattttttcctgacgtgttttagtgaccgcatctgacgcattttgaagctcttttgcatgagaagaaatttccactttgtccttcggctttgcagcctctttttgtacggcttgcttttcgtaatttttttggtatggattaacggattgtgttccgtactgattgattttcataggattcctctcgctttctgttcgcagtctaattcttttatcgactgcgttatcagttagtttagggaatcaggtgtttttggtattataggcatagtatgtgtcttttgtactgtttttttctttgaattcagcggctgttttttggttcatatggtctaattgcgactcaatatctgtctgacaggacttgcaaaattttcctgtcctgatcggatttccgcacctttcgcaaggatatgccaaattcggaagctggctgatctgaatccttttttgtttgataaacttgaggatcagctcttcatccacacctgtttcctcagtgatctgctgcatcgtcgactgtctgttgatctgctttctcaaaaaattatagacggtttcaaatgctttttcttcttctttaatacatgcctggcacacggtctgcaggttcgttttaaaaaataaagcattgcattttggacaattcgccaattcacccatcgtattaactcctattccttctttaatctgccttatatttctatcaattatatcggcagaaaaaaagaatgatttagctcctgattaaagtaaaagaggagaccgatgacgctttacccgctgtcagcaggacttcggcggcttgatgcagtgtggcgcccgtcgtataaatatcgtctattaagatgacgttcataccttcggccgagttttcggctgctgaaaactttttttctgcggacagcctttctgttttgctctttttggattgtttttcattgttcagtcggatgagggggaaaatgacgggcattccgagcagagaggccagcagctcggattgattgaatccgcgttccgccagccgttcgccgctcagcggaatagggatgagagtatgtgtatttgatggatatgccgctttaaagccggcagcaaagtcacgtccaaatgcttgaatgattttcgcatcacccctgaatttaaaccgggctaatgagtccttcatcgcatcattatacaaatataccgaacggttttgccgcagcaaaaagcgcttttccgtttttgattcccgggccgcacaatcagcgcatttttcatttgactcctgaggcctcccgcatatactgcatacggggccttcaattttttcgaatcggctgctgcatatggtgcatacctcttgctcgggcgccagagaaaacaaagatctccaagtcaatgaacttgaaattggtgagtcacacaataaacaattcagagatattacgctccttcccaagtttcacagaactcgcttggattaaccgaaacaatcgcggctgattcagccagaatgacaagcagcgccgtatttttctgtttatcaactatctctgcttttgcataagcaactttctttttatctgtaacatatgccggctcagcccggtttaatgaaagtgccagtacatcatttttgcatacccggcatgtgcatttcatatgaagcttaggcatatggcggtcgagaagttcctttaatatgatttctttagaattgacaagcatgctgacagctcctcataggaaagtatgagtatactgtatcatgttttctgaaattaactagtccaacaatttacttttttgtgccaatttgttcataagttctatatgtttttttgcttttttcattccgtttgtcattccgaaatgaaacaggacgacatcaccgctgaaatgtttataatgccttcccgttctgcccgcgatctgtacgagcgcgctctcagtaaagataggtgcttctgcgccgaggacacatgtctgaactttgggcacggtaacccctctttctaaaatcgtagtcgttaccagcagatcaagccggccgtctctgaatcgtttcactttatcctttctgaatgtgtcttccgcatgtacgccttctgcccgtatgtttaatttctgaaaataatccgttgtctttttcaatacgtgtacagacggaacgaataagaaaaccggcagctgtgattgaagtttttggcggacccaatccgttacagagcgcggcagttttcctttctgaagcttcttcttccaattgccgcaccacaaaaaacgcggctccggcaggggtttccgatgatatctggccggtatgcgaacgcttttcagcaaaccggcttcagcattcttttttaatgtgtctgaaggagttgccgttacataaacaagggcgctgtttttcttcctcgctttatcaacagcgaatcttaatgtctcatcggctgaaaaaggaaacgcatctacttcatctattatcatgacatcaaaaatgtctcggtagcgcatcagctggtgagcggttgaaatcatcagcggagtcaagcggcctttgtcctcgctgccgccgtacaaagcagaaacgtcgactttctcaaatgcttttttcagtctcggcagcagttcaagtacgacatctgtacgcggagtcgcgacacagacgcgcaaaccttgattcagggcaaactcgataccaggaaacagcatctctgttttccccgatccgcaaaccgcccatactaacagctcttgtctctcttttatcgcatctgtaagcgcggcggcggcctgcttctgtccgtctgtcagtgttccttcccaagaaagctttacaggctcccagctgttttcaggggcttgattccaagaatataatgatgtcagttcatcagcccttcccatcatgacacaggcacggcaataggtaatctgccttttggcagagggcgcccaaaatgccgcaaagcaggcttgatcagactgaccgcatcgttggcagacgtaacggtttttccggcggatgattgacggctcggccgttatatgctctttttctataaaacggttgatgcgctgatctgaaaacggtatctcagatctcaataaatgccggccgtaaaagaaatcccgcacctctgaaaattctgaagcaccttcggacatctccctgcctcctttctgttcaaagtatgcctgccgggaatttttttgtcgaatcacgaaaatttaataataaaaaaatctccgcccttgaaaacggagattttcacttagtttttaaagcaccagccgattccgatggcgccttcgcccaaatgggttccgatcacggcaccgaaatagctgttatagaattcgacatgaggatatttaccgcttaactcctgtataatatccgccgcttcttcttccctgtttgcatggatgacagcggcccgcatcgggattcctttacttgcatcctccccaaacagttcaaaaattctcgaaatcgcttttttgcgtgtccgaatcttttcaaaaggaacaattatcttattgtcaaaatgaagaataggctttacctttaacagaccgccgataaaagcctgagcactgcttagacgcccgccccgctggaggtgtgataaatcatccaccataaaatacgcacggactgtttttttcatttcttccagctctttaataatctcttccggtgagtcaacaccgtctttaatgagctgtgctgcctttaatgcataaaaaccttgcgccaaacagctgatctctgaatcaaagggataaactttaatatgatcaaccatagtgtttgccgaggcggcgctgttataagttccgctgattccgctggacaaatgtatgcttatgactgcgtcatatgttttgcccagttcttcgtacaatgcgattaattcaccgaaagaaggctgggacgtagtcggcagctcatcatgattttttacttctttataaaaacttctccagtcgagttctgtttcttcgcggaatgttttttcaccgaaaaccacttgaagaggaatcatatgaatatgatgttcttctctcatctctttcggaatatatgctgtactgtctgttacaactgcaatcttcatcactttacctgccttattaagtacttaataagtattttaatagatatgaagctgtaaaaaaagacttgcctattatggcaagtcttctcatacatgactaacgcatctctacccagccgtttttaatggctacgacaacggcttgtgtccggtcattaacgttcattttctgcaaaatattactcacgtggtttttcactgttttctcactgataaacaatgattcaccgattccgcggttgctttttccgtctgcaagcatttgcagcacttcacattcccgtctcgttaatatatgtaatggtctccggatttccggataaacctcatgctgaggatgagcagaaactccgcttgtcgcaagacggcggaattcgttgacaagattgtgggttactttcgggtgaaggtaagaaccgccctcggctaccactttcactgcttcgattaaagtatctgcgtccatctctttcaggagatagcctcttgcacctgtttttaaagcatgagtcacatagttttcatcatcatggatggagaggataatcaccttagattcagggtacagctcaacaagctgtttagtagcctctactccatttacattcggcatattgatgtccattatgacaacatcgggatgataatgctcgacgattcgagccgcctcatctccatcgtcaccttctgctaccacttcaaaggtaggttcaaaatccaatattctttttacaccctcacggaatagttgatggtcgtcgataataacaatatttactttagtcacacgctacgcctccttatcctattgttctatatacgccgctgttcggtcaatatgtcttttggctctatttaacaaattataggccgagagataacggaaccttaatcatgataaatgtcccaagacctattttagagtctatcgttatcgttccttcaagcagatctactctttctttcattcccagcaagccaaatgacttgtttttcttttgtttagcatccttaatatcaaagccttttccgttgtccttaatgataagaacgacaaaatcagcggttacttccacttttactgttatttcctctgattctgaatgtttgagtgcatttgtgacggcttcctgagcgagacggaaaagcgccacttcaaattgcggggcaagccttttgttctccgtgtctccgatacactgaaaatgtattttcacctttccgttgtattcttcagttgtataaagatattttctcagtgtaggaatcagcccgagatcgtccaatgccatcggtcttaaatcatatataatccttctgacttcgtaaagggcattccgcacattctgccgaagatttttgatttcctgaaatccgtcctccgtgccgcggtcgcggaagatccgttcaattaattccgatctcatcatgacatttgccagcatctgcgcgggaccgtcatgaatttctctggaaactctttttctttcttcctcttgggcttcaatgattcttaagccgaaatcttgtttagcctgcgcatcggcaagaagaagccctacttggcgaaggtcttgattcaggtaattcagaacgacggttatttggctgaccaatgattctgaccgttcaatgatttcctgaagccccaaaagccggcgttctaaatcatctctgcgctcccgcagctgcttttcacgctgctggatcatcgtcagttccacttgaagtttgtgcgccttttcataggcgttgcgaatttcttcttcgctgaacttatggaaatttctgcttacttcagacaagcggtttcgtgcgtgccgcgtatgaacttcaagtttgtcccccagctcaatgacttcgtacacctgctgtttgatctgtttgagttcttcaaccagctgctcatattgctggcgcgactgctctccgatttgaaaaacctcgtccttgctcccgtccacggttttcagcattttcataagtatagaatccaaaactttggagtccatcttcgatttattcatctgtctccctccgtaacggtgttgttatgtatttttattataaatgtaattgaactgcaatttatgtcgaattataatgaaagaatgcgtatattctagaaaaaaacatttttatatagtatcttactctttcatgataccaaaatatgcgcaaaaattctaaagtctgttcgaatttgtagaaacaagtcttttaatgcttgtcaggagggtccagcaatcatgctgcacagctatttaactgttaaagaaacgggtgaacatgagattgtgattgaaaaatcacgttttatctgtcacctgagccgtgctgcttctgaagaggaagcgcaggaatttatacaaaagataaaaaaacagcactggaatgcgactcataactgctcagcttatctgatcggcgaaaccgaccatatacaaaaggccaatgatgacggagaaccaagcggcacagccggcgtccccatgctggaagtgctgaaaaaacgcggtctgaaagatacctgcgcggtggttacccggtatttcggcggaataaagctcggtgcaggcggattgattcgtgcatatgggaagtcagtgtctgaaggcttaaatcatataggagttacggagcggaagctgatgcggattatgcatacatcagcggattatacgtggctcggcaagatagagaacgaactgagagaatcagtttttttactgaaagatatccattatgcggatcatgtcgaatttgaaacgtacgttgaagaaaaagacaaagaagcgtttctaaaatggatgacagaactgacgaacggcaagagtaagaatacagagggagaactgacgtatttagaaacagacgtcagccctaaaggagactaatgtaatggctgaacgtgtaagagtgcgtgttcgaaagaaaaagaaaagcaaacgaaagatcatattcaaacggattttgctgctgcttaccctcgttttgttagttgctgccggatttggcggatacaaagtatacaaaacgatcaatgcggcagataatgcatatgatgccctttcccgcggagaaaaatcaaaattgcgggataaagtcatcaatatgaagaaaaaaccgttctccattttgtttatggggatcgaaaattatgccaccagcggaaaaggcggacgatcagattctcttattgtcgttacccttgatccgagaaataaaacaatgaaaatgctgagtattccgcgtgatacgcgggtgacgcttgccggcgacacaaccggcaacaaaacaaaaatcaatgcggcttttgctaagggcggagcggatgaaaccgtctcaaccgtcgaagacttattaggcataccgattgataagtatgtcactgtcgacttcaatggctttaaggatgttattgatgaagtaggcggggtcgatgtaaaagtgccgtttgacttcgacgagatgagtgacgtcagtaaaaagaaacggatctatttcaagaaaggaaacatgcatttgaacggtgagcaggctttggcttacgcgcggatgagaaagcaggataagcgcggagacttcggccggaatgaccgccaaaagcaaattttaaacgcactgatcgaccaaatgtccagagctggaaatattgctaaaatcgataaaatcgctgaaacagcgagcaataatgtccaaacgaatatccgaatcactgaaggactcgctcttcagcagatttacagcggatttaccagcaaaaagattgatacactgaccataacaggatcagatttatatttaggcggaaccgcaactacgcgcggaacatattatttccagccggatccaaccaatctcgagaaagtacggcaggaattgcagaagcacctggattacccgtccggaaacagcacggcatccgatcccgcttctgacagcaccggaacggacagtacgactgattcaacttccggcagcacaggaacaggcggtacggctgattcgacttccggcagcacaggaacaagcggcacaaccgattcaaccaacggtactgcaggtgcaaacggtacggacagcacacagtccggcggcacaacaggctattaagagtaaacccgatcctttgagcaggatcgggtttttctatataataagagaatagcaaaaaagcagaccattcgcatgatctgctctttttaatttttctttaccaatcttttgtaaaacttggtaaatggtttaaattgttcatttactaaccctgtgacctctgctatgatttgcataaatacaatcaatacaaaaataataaacagcgaaagccaaatggtcgcgcttttcagcaggatggcactgacgctgaaaataaagccgattaaataaatgataatgacagccgtgcggtgtgacagcccgaaggccatcagccggtggtgtatatgtgacttatcaggcgctgagatcggctgtttgtttaaaatccgcctgatgacggcgaatgtcgtatcaaaaatcggcacgcccaaaatgatgatcggaatgatgatactgaataaagtaacacttttataaagacctaataatgagagtactgagatgacgtatccgagaaagagcgatccggtatctcccataaatatctttgccgggtgaaaattataaaataaaaatccgagtgtgcttcctatcacgacaagtgaaagtgacagaataaggattttccctccggacaacgccataacggcgatagtggagagtccgatgaccgacaggccggcagcgagtccgtccaaaccgtcaatcaggttcatcgcattcgtaataccgacgatccataacacagtcagcgggtaagcgacccatcccaattctaaacgttccgttaaaaacggtacggagaaaaagtccattttcagtcccgtgctcacaatcataatggccacggccagctggacgaaaaactttacctttgcgcttaattggtatttatcatcaaggattcctaaaataacaataataaacgcacccaccgtaatggcggtcattttcgtttcattatatatgccggccgcgagcacacccgccgctacgccgataaagatggccaagccgcccatacggggcattattttatcatgtacttttcggttgctgggctggtcaactgcacctattttgatcgcaattttttttacgataggagttaggattaaaaccgttagcagagagacaaaaaacgcaacaactatgcgaaacatgcgttcgtcaagcataaagaagtctcctttggaattatatgaagtcttttctgatattgaaccgttccttccattataattcttactagttattataacaagcatcatcaaaaagaaacacgcaaatcaaaaaatgcgctttcccttttaatgggattgcgcattttccaatatacccgtgcattcaagcattcggccgaataaaacattccaatcccgtccccgggccaattcacggcgcaaagcctcgtatgatccgcggcggtccgctgccagaagcgcttcgcaggccgcgatgaaatctgcggggtcgctcccttcaacgtattcataaacgtaaggccttttgatttttgacgtagaagaaaggttgcagccgacaaccggtttcccggcggctaaaaattcaaaaagcttaagcggaaataccgcgtcattataaggtgaatttttatacggcatgatgccgatgtcgacaagctgcatataggacggcacttcattcggcgcggcaggtcccgtccagatgacattcgggcgttccagaagcgactcgaaatccggatcgtcctgagccgtgttcgggcccaccaataaaatcgtccagtcaggccgcaaatctgccgtttccgccataagcgcaaaatcgagctttggtttgattccgccgataaaaccgagaaccgttccgtttcgtccccgtaaaatgtcttcatccggctgtttattttcccgtgaaaacaggtcatattccactccgttttcaatggtgaacactttctggtgcgggttctccagcttttttccgacctcccggtgcagacagtcagatgtgcaggtgatggaatcggcacgctgaatgattctcatttccgcctgtttaatgatgtttcttcttacatttgacagcacaccggcccggccgctgatcggagcggcccacagatcactgcaatcgtaaatcacttcatcccaaggaaacagatctgccagaagcgggaaaccggggaaggtgtaccataagcagcagcgggccccttctccttcttccttcagcatgtgcaacaatggtgaaagtttatgcctgtaacacatgtctgtatacctgccgaaacggaatgctttttgctgcatgagatcctttacagtgaactgccggattccctcggcgatcccggccatctgatcatcattggctcgcggggacgggcatacccaaatgacgcttttcgtttctttttgccgggcaagaaattcagccagccgatgccgtctgtatctcagccggtcatgcccccattccgccgctccgacgattacgtgaataatcggttccaccttcatcacccagctcctctgacgcctacagtcttttcaagaccgcgtttttcgcatattgcataaaacaccacgaagccttgataaaatgcaggcgctcaatttctctataaacaaaccacgttttttttgcggctttccacttgttgcttgaaatcgaattctgcacaagcctgtattctgaaaggcactcattcaggccgtaagccgtaaatccccttttcagcagggaaagccatgtcgctaaatcctgccgcgttctgatatcaggcatttgaatctgccccgtctgctctctgtcaatcatgaccgttaaacatccgataatcgtgttttttaaagcttcatcatatgacaggctttcaggggcttgaatcgttttgtccgtcggcgttccgtcctgctccatgacgctgtagcccgtaaatgaaaaagcgcaggaccgctctgccataaacgcaagctgtttttgaagcttttcctttttccatctgtcatcgctgtccagaaatgcgacataacggcccttggcatgtttaagggctgtatttctggcagctgcggctcccccgtttttatctaaataaacgacgcggatccgctcatctttttgttcatattgccgtaaaatatctctcgttccgtccgttgaacaatcatccgcgataatcatttcccaatgcgggtggctttggtgtaaaacggactgaatcgtgtcttcgatatattcacttgcgttataagacggtgtaatgacagatacgaaaggtttccagtttgtcatggtcacatctccatcgcagatttttacaaggactctctaaaaaactcaggaatgacaatgaacataaaggcaactgcaatgccgattaaaacgcccagaaccgctttctttttcggcggcatgccttgaccagccgtttcattcatcggctctgaattgatgacgccggccgctttcaggttcagctgcgtatttttcaattcgtataaaaatcgttccttatccactttggcgtccgcgctgacggtttctccttcaagcgcagcaatactctgccgcactacttttgcccgtttttcaaacaggtcctgatcattcttcagaaaagttgttatgacggcttgaaacaccgattcggtttcctgtttgttttggccgctgcagctgaccgtgatcaatgaatctgattgtgtttcgacagtcagtttacttttcacggccgctctttcttcgtctgttttatgaggcagagcctgctttaaaaaggcatcgctcgtcaaaaggagcgggatttcttttgtattgttataaagcggatgatcataatttcccgcggcgatcgcggcttctgatgtaaaactgctgtttccgctgatttttgacggcaatacatatcccgccgcccctaacacaacgggcagcgcaatgatccaaatgatattctttttgatacgccgggttattcttgtcaacatatccttcatctcgcatctccctgtttttcatagtacgccgtgacggcaggctccttttgtaaacgcctcaatatattgaccgccgcgatcacgagcgagagaaatacccagtggaaaaataaattcgatacggagcttgggctgatgctgcttaccaaaaaaccggccatcgccgtgataagtccttctgtgatcagtcttgactgattttccgattttctttcatgacatttataaagtgtccaaaaaaggaacaaatagactgtcaggtaaccgagcatcgtaagtacgccgaagttcgccataatctcgacgagccagttgtgcacctcaactacgccgcccgtatcataaacgggctccgcttttaaatagtaagagacgtttccggcacccactccggacccccaggaatcaattacatagtgaaaggcgttctttaaaagattcgccctggcgaggttggaaggaagcggctgctgtcccggcatcgcctgcggagctgaaaacagattcaagacggcattggtgatacggcccgcaaataaaaccgcaaacagcgcagcacccgctcccgcagcgtacagcgcgaattttttcaacagagaaggcagcaggatgaagacgtatacagccgcccccgcgcatatgcccagcagactcgcgcgcgaaccggtcaaaatgattaaatacaaagcgcagatcgctaagagcaggctgacggccttcacatagccgtttttcatatttttcaccgccgccgcatacagaaagaaactgatgcacaaaaacgtcgcgaaatcattttgattaaagaaaacggacgtcggataatgctgtttgtactgcgggccgttataaagcgtggagctcggcagatggttgtgtgtaaaatggttgtaaaagccgatcgccatcacaaaaatggtcatcacaagccatatgccgtaaaaaaccatcagctgatcaaagcgctgaatgaacatgacaataagataaatcaaaaacatgcccattcctattaaagctaaatatttaatcccgtacgtcacggattttgcccacaataacgataggagaccgtatgtaaaccataaggcgaaaaacatcagaaccccttttacattcacccgattccatctgtcaatatgatgacggtttgtcaggatgccggcgatgtgtagggcgcccgctccgattaataacagccggtatataaataagctgaaaaatccgagatgaaccgcaaagaaggcctggtttaaaaatgtacacgcgatcagtatataaatgagccccataaacatctgaccgtttgttgtaaaggcggatagcaaagcaagtccggcaataccgatcatggcggcaagcagcagcacggtgatttttccgaggccggcatccgccctgaccgcctccagcatgatgaatcctcctgtaatgacagcggcaagcagcacaagaacatgtgccgctgaacgtttgatactcacatggcaaacccctttccaaaaccggcagccgagccgggctgccgagagcctgaagacaaatctttttctatcttgccagttcttttatttgccgatcggcatgaaccgccggacgtccgacggaatgataagtgaatcctgaaaccctcatatactccaacggaaacatatttctgccgtcaatgatgaccggctgtttgagcagccgcttcactctctgaagatccatctccttgacttccggccaatctgttgtaatcaggcatgcgtccgcgtttttgatggcactgtacatctctgcgtgatattcaatgccgccttctcctaatatcgctgccgcttcgggaatcgcgatcggatcatacgctttcacgtgagcgccctgctctttaagacttgtgatgatatcaagagccggggcggagcggacgtcatttgtatgcggtttaaaggccagccccagtacggccacggttttcccttttaagggaccgatggcgcggttcaatttttccgtaatacggaccctttgcttctgattggtttcaatgacggcttccatcatttcaaacggatagccggcggcgtttgcgatatgcaataaagccattgtatccttcggaaagcaggatccgccgaatccgatgcccgcctgcagaaatttattcccgatccggctgtcaagaccgacgccttctgacacgtgagaaatgtccgccccgacacgttcgcaaatattggcgatatcgttaataaaagatattttggcggctaaaaaagcatttgcggcatacttaatcatttccgcgctttcaagattggtctttacgatcttcgtacggaacggcttatgaagctcttcaatgaccgaagcggcatgttcgcttgtggcgccgataaccgcccgctccatctgcatcgtatcccgcaccgccgaaccttcgcggaggaattcaggatttgacgcgacatcaaacggatatgttccctttgacgcttcgctgacgatttggtaaacgagctttcccgtcccgaccggaacagtgcttttggtgacaatgattttgtatccgttcagctgttctccgattgtttgcgccgctgccttaatgtaggtcagatcggcttcacccgtctttgacatcggcgtaccgacggcgatatagatgatatcagcggctttcacagccggctcaatatcggccgtaaaggataaccgcccgtcactgacatttttttcggctaattcctcaagccccggttcatatatcgggatgactccgttttgcaagcttctgattttcgcttcattgatgtcacagcaagtcacatgatggccgatttccgcaaaacaagttccagatacaagacctacataccctgttcctaatacagcgatttttttcacagcttcatccctctttcgaaaggttctcctcttgcccggaccggttcatgacggaccggtatttctctttcagcgctttcgcgttttggcttgcgtcaaaatacgtgcggacggtttgataaagttcctcggctgtttgcggcgtccaagcctctccttcgtcatattgcagaatggattctgccagcgtgccaggtgaacccggcttgatcagcaaacctctatatttcccaaataaagaagccaatcctccgacatcggtacagatcaccggcaccttcagagcgagcgcctcaatgaccacagtcggcatgccttcgctgtaggacggcagcgccattacatccgaggccagcagatagtcctgtaccttgtcgttcggcacttgccccgtgacgatatgagcggcttcacgcaatgaagatgcggctggaccgtcaccgacaaagacagcttcatatctttcatccaatgactgaacggcttttgataagtcgaaaacacctttctctttgacaagcctgccgatgaacacgatcagttttttatccggaggaaggccgagccgttttctgacggcttctttcgtctcgttcctttttcggaaggcgtcaagcgtgatgccgatcggaagcacgctgcactccgcttcgatgagctttttcatttgttcccgcagactgccgctcacagcgtaaatatcggctgcttcccgcaccgcaaatgtaaatgcgcgatgagcgcttttgctgtaatgcggatagacattgacatcactgccatgcaaggtcagcacatacgggatgcctaaagcctttgacacaatggcggccgctccgcctgacggcatggcgaaatgcgcgtgaatcagatcgggcttcaggccatgatttttaatttcggaaagaaccgatgacgccattcttttatgcggctgcgcccatttcagctgcccgggaaccgcctgataaaacggccggtggacggacacgcctttccgccattcatgcgccggccttatatccttttgccgatacgtctttttcagcacccggaatggcgcggcgagtttcggccggggacaaatgacagtcatctccgcgccaagctttctcagttcttgggcctgcgtctcatgaaaaacgccttctcccggcttctcactgctcggatatacacttgtcatccacaataccttcatagcaaacgtccttttcttaatttacttttcatatgcggataagcttttcctaacaggaacaaataacacaacgctccgcaggatacggagatcgccagccgcagcttgacatcaaggctgatccgctccgtcccgaagctggctgtaaaggcgatgacacccattgccgccgtaagcagaaacggtttggccacggctttgaagtaagccgacagccgcagcttaatgacatatgccagcagccagcgcccgatcaggaaattcaggatgctgatgaaagcgtacgtccaggctaccgtcaagagatttccggacagcacggcggcgtacaaagatgcaccatacagcagcatcaccccggcgtcccaataaaatgccagatcggcccgcccttttgccagcagcacagatccgttcggattcatcagaacccttaaaatcccgacgatggcgagaacgtttaaaaccgggacagccgccagccatttttctccgaaaaccgaagccacgaatgcatccgatactgaaaccaaaccgagcaaaagcggaaaggatatcagcgcgagtattttggtcatattgagaaaaccttctctgatcacgctgttttcatgcttgtttttcgcaaagacgggaaacgcgactctcgtaatgatcggattgatttttaataccggaagcgtgacaatctggtaggccagattgtaaatgccgagcgcctcggcgccgataaaactgccgatcagaatcatatcaatattcgccccgagccggttcacaagccgggaagacagctgaaaggctccgaaagaaaagaagcctttcattcccttcagatcaaaaacgaacaccggtctccatgtttttctgcaggacacccagtacagaataccttttgacgattgcagcagcacctgggaaatcacataggcgagaatcgggtccgtataaaaaaccgcagccgccaagtaaacgaaggacagcacatttgaaaagatttcaatcttgcttagcgtgttaaatgccagcgctttttgcagcatatattgatattgctgaccgatcggcgcgattaaaaacatgacggccagcacgcggattaaatagacaagctcctcccgccgataaaaatcggcaatgagcggactgctgaagaacagcagcgcaaacagcgcaagccccgttatgatattcagccagtacaaggaagacatctgtttatcagtcacatgatctttttgaatgagcgcggcgccaaaacccatatcaagcgcaatttgggcaaacaccactaccgttgtgatcatgccgacaaggccgaattcagccagtgacatgacccgcccgagcagggcgaattggacgatttgaatgaccgtaatacacgctgtcgaaatacttgtccatttggcgccgctcaaaatttgatttgtaatactaggcatcgttttccctacttttttgtctgctgaccagaatttttatcgcgccccgtcaccggtccagatcactttgcacgttttgagcataatcttcagttccaatgaaaaggtcaggttgcggatataatataagtcaaacatcagtttttccctcggtgtcatgtcatatcccccgttgacctgcgcccagccgcttaatcccggcttaacggccagccgctccgtaaaccccggaatctcagcctgaaactgttccgtaaacacgggacgctcgggacgcgggccgatcaggctcatttctccccgaagcacatttaccagctgcggcagctcatcaatacgggtccttctgataaaagcgccgacctttgtcacgcggggatcctttttcagcgcccagaccgcccccgatttttcagcatctattttcatagagcggagcttatacaaataaaacggcttcccgtctttgcctacccgctcctgcttgtaaaaagccgggccgggcgactccaaacgaatcagtatggagaacaggcccatcaccgggagcgccgccaaaagccccgcaagcgcaaacacaatgtccatgaatcgcttaaaagccaaataacgggccgttctttccgtaacggcagcggaagtcccctgccgcactgcatagttattatttacattcatgcttttctctgctcccactgacacacacctcacgatttgttgggatgtttgatgacctatgccgtgagtttagcagatggatgttaattggaagtaaaggaaacgttaatgtttattagaatgtttcgattattgtttttttattgtaaatctattcatatccatatttgagacaaagcataatgaaaaaataaaaaaacagaccggtatgaaccggtctgtttccatgaaaaaaattatctgaaataggaggaaacgccttgggtgatccccgccgcgagtctgtcctttttcgttgattgttttagaatattggcatcaatcgggcttgtgacaaaaccggtttctaacaagacactcggcattttagaatacttaatgacgtaaaatccggcagttttcacactgcggtcacgcgtgccgagagcagaaaccattctcggctgaatattttgggcaagcctcagactgtttgccgattggtaggttttatcataatacgtctccgtaccgtttgcactgctgttatcattcgcatttgcatggacgctgatgaaaatatcggcgttcgccttcgcccctttgttcactctctcctcaagcgaatcaaaggtgtcgccctttcttgacattacagtaagcgcgcccgcgccgtataattgattgttaagacgcgtagcgatatcaaggtttacatttttctcaagcaagccgtttccggttgcacctgaatcctgatagccgtgtcccggatcaataaagaccgttttgccgacaacgggatttttaagctgcgacgcggcattgttgcttaaagatgaagcacttcctatgacggtgaagctggtgatgtttttacttccgatatacgtccggacgtcttttgacagactgtctccattcgtcagcaggtgaactcttccctgtttggcgctcagcacgcctccgacgatggtatccgcctctttaaagccattggtaacaaacgtatagcctgtgcttaagcctgtcttttttgcaagattcacagacaggttatagcggtttttgccgctgattctcgaagggttcggcagcttattataaagtgagctgctgatgctgcttgtcccgccgatgacaatcgtgtttttaatccctaagcttttgatcgcattggacgcagaaccatttaacgttgaatcattagtgaataaaatcggatattttttagcggacgcataagaaatcgcagccattccatccgcatcaacaaacccgttgaccacaagggctgtagaagatcttgtcatttcacccgccacttttgcggctgtggcatatctcgtgctccctgataaccgtttgacactgatgcctaatttagcaatttgatttgcggtatttttcgaaacggcaggtgtgccgcctacgataatcacatttttcgtttttaaatcaattaatcccttttttgtgccggcagacagctgatctttatttgtaaacagcagcggcgcatttttttgatatgcaagcggcgcagcggcaattgcatcggcatatgaagttccgccggtgataattaccgttttcgcttcaccccatgattgttttgccgccagtacagccgtatcataccgggtgcttccgccgatccttttaaccgtgttgtcagccaaagcggaagggacaaatagaatgaccccgagaataaagacggggagacattttatgatgaatttcaatccgatctcctccacagaagtttagtagtttgtaagtgctgtattaggataatagaacgcaagaatagaagtatacggctctccggcctccgctctttcttttgctccgtattgactcattcctacgccgtgaccgtatccctttcctgatatcgtgatttgcgaagaattaccggacgcactggcgtatgtgcttttaaaagatgaagctccgatcatcgtcctaagttcagacgctttcacctcaacagatgcagtcttgttcatgacatagcccttcgacttgtcattcacatggtacgtgaccttcaccgcggcgtcttccgcgcgctggccttttgtttttccggtgagcgagagatcagagatacttgcaatttttatggaacttgcattggtttctttatttttcatcagccaattttttattccgttgagctgcgcagcatttgcttcgtttgttttagaccaccaggatgcgggatttttcatatccagacccgctggcagctgctgcttctgcaatgttaaagaccagctgatttcgggatcttttgtgtcctttttggctactaaatacggcactttcgatccccacacttcatcgccggcttccatgtaaccgccattgcttgatgagtaagtggcatctatcaatctgccggaataagtgagcactttcccttttgttccgttaacggctgcggtggcgtttggataccagctgtatcccccgtaaacctgaaaggccgttgtatccgcgactgtttgtcccatcttgccgatagagtaggtgcgggcggcaacagcctgggctttcagcgcttctgtcggccagcttcccggcatttcattcggcaggacacctttcagataatcctcaaaaggaatgttttcattaacaggtcttacatatttgccggattcagcagtgaaactcatattccccagatatggcttcccgtcaatgctgattgtgtttgctgttgaatatttttcaggaaccgccttgaaagacgtttttccgctgttaatgcctgcaacgcctaatttgccgccggacgtttcaatacggtacgtctttccgtttacgagataaaactcttttgcgtaagcagccttaactgaatcggcaattgaattcgcgctgcctattaatgtataagaataggtgcctttcgttttaaaaaggccggcctcgtcggcgggtgtttcgctttttttgatgtatacaagcggcatgtgatttgcggcggcaatatttgatccgactacgatgtccgctaatttagtcccgttggcagccaccgttttgcttgcatccatgccaagcgaagtgactgcgtttgctgatatttgatatctgtttgatccggtaattcgtttggtgaccgaggccttctttttaatttgattctccacatctttgctgacgcttgaagtgcctcccatgatgatcacttttttaggcagattgtagctcggaagggagtcttttttcgtcagaagaatcggatagccgttttgcgcggcatatggcgcgattgccagcgcatccgtatatacatcccccgttactacgaccgcctggtcatagctgcccatttcggccgcaatatttttggacagatcatatctgttttttccgctgatccgtttcgtacggccgtatttcttcaatgtcttttccgcggctgacgaaatactgttcgtcccgccgatgattaaaatattatccggattgaatttcttgatttgcgcttctgtgctgctgctcagttttttcgcttcagtcagcagaacaggcgctttcagtttattcgctaaaggaatgacggaaagcgtgtccgcaaaataagcgtccgtattcacgacgactacgttggacgggtttttccaatacttagatgtcgcggcgttagccgtatcatatttggacgcgcctcccaatctgacaacggaggacacatcgcttcccgtcagtttataagttcctgaaggttcgatattcagagtcgatttattaccaatataattcgtcagttttactgagatatcagaactggccgcaaaagtgctttccggtaataaagccaggctgaatatcacagaaaaacagacagcccatattgttttcttcaatttttatcccgccttttgctgatcatggtgtattattttgctttctcgatttccttgatctctttttggcctttatcatttgtgaaataagtaatgctgactttgtcattttcgctgaatttattcagaacatcagagaagtcatcagaaaattcaaagctgacgggctgatcatccacttttacttcaattgtgtgcgtatccgccataccgatataatatgccgtttctttttgagcctggttctccgaagaaccgcttcccttctttgattgttccgccgttccgcacgctgccaatacaacagaaaaaagcagtattaagaacgaagctgcaatagtttttttcatttttttcacctcatctttatgtatcgtcttatactaactttttttaaggtaattttaaggtctttttgtaaccttttttttaagaatttcgtctattacatggttataagtaaaaatatgactgggtttataaagattagtaaattgcatcatgaaagttaatagaaaaggtgatgacaaatgagagctgaacgaaaaagaaagaagaaaaaggttcttctgacaatcgtaacaatcatcgggctgttagttttatcatcaggaggctacgtctactacttgtggcacaaagcggcttcaacggtggcaagcattcaggaagacttaaaaaaatcggacaaacgtgacacggatatagatctcggaaagaaggatccgatttctgttttaatcatgggagtcgatgagcggaaaaatgacaaagggcgcgcggacacgatgatttatatgaccgtcaatcctaaaacgaatacaacggaaatggtcagcatcccgcgcgatacgtatacgaaaatctccggcaaaggtacgatggataaaatcaaccactcctatgccttcggcggaacccaaatggccgcggataccgtcgaggacctgctcgacgtgccggtagattattttgtgaaagtaaacatggagagcttcaaagataccgtggatacactcggcgggattacggtgaacagcacgttcgccttcaactacgacgggcattctttcggaacggggaacatcagcctgaacggcgaagaagcacttgcctacacccgcatgagaaaagaagacccccgaggggatttcggcagacagcagcggcagcgccaagtgattgaagggattatttctaagggggcaaacatctcgtctgtcacgaaattcggagatatgtttaaggtcattgaaaacaatatgaaaacaaacatgtcattcgatgatatgtggacggttatgactgactataaaaatgcccgcagcaaagtcactcagcatgaactgaagggaacgggaacgagaatcaacaatatctattattacaaattagatgaagcaagcctcgcttcagtcaaaaaagaattaaaagaaagcctgaaataataaaaaactctgcatatgatgcagagtttttttattctgtaaaaggctgcggacgggtttttctatagccgtaccgataaagcagttcttccgcaatccgttttgaggccgatccgtcaccataagggtttgacgcctttgacatccgttcatactcggcctgatcggttaagagctgttttgtcagctgatacaccgtttcttcatctgtacccgccagcttcaatgtcccggctttcactccttcggggcgctcggttgtgtcccgaagcaccaagaccggctttccgagagaaggcgcttcctcctgaaccccgcctgagtcggtcaaaatgaaatttgctttcgcagcgaagttatggaaatccacgacctccagaggttctattaaatgcaccctgtccgaatcagcaaaatgggcttctgcggcctcacgaactgcgggattcaaatgaacgggataaacgacttgtacgtcctcaaactcttcaacgattcttctgacggccttaaacatctgttccatcggcctgcctaaattttcacgtctgtgcgctgtcaaaagaatcatcctgcttccttccagcttgtcaaaaatcggatgagaatagtcttcccgcactgtcgtttgaagcgcgtctatcgccgtatttcccgtgataaatatagaatccggctttttattttcagcaagcagattctgttctgcctggcttgtcggcgcaaaattcacatcagcgatcacgcccgtcatctgccggttgatttcttcagggaaaggagagtatttattttgcgtacgcagaccggcttccacatggccgacggcgatttgatgataaaaggcggcaaggcttccggcgaacgttgtcgtcgtatctccgtggaccaaaacgatatctggttttacttcttgaaacagcttgtccagtttcagcaaagcatgagatgtaatttctgaaagcgtttgacgctctttcataatattcaaatcaaaatcaggcgtgatgctgaatgcttcaagcacttgatccagcatctgtctgtgctgtgcggttacagtcaccagcgaatcaatttcctgatatttttcaagctctaatacgagcggagccattttaattgcttcaggtcttgtaccgaatacggtcattacttttagttttttcaacggtttgtctgcacctcgttttatatgtcggatatcccttcatgttaacatatttatgccgtttcttaatattgtaaagcttaatggcaaacaaagcaaaaaccgttacaagactctttgaaagcggattaaaaggtgtgaattttaatcaattgtggtaaagtggaaaaagactaggttatagttctgaaaaaaagattttgcagaaacaaggatggtgttattcagtgaagaaagtacgcaaagccattattccggcagcaggtttaggcactcgttttttgccggccacaaaagcaatgcctaaagaaatgcttccaatcgttgataagccgacaattcagtatattatcgaagaagctgtcgaatccggcatcgaagatattattatcgtaaccggaaaaggaaaaagagcaatagaagaccatttcgacaatgcccctgaactggaacgcaatttagaagaaaaagggaaaatcgaactgcttcaaaaagtgaaaaaatcgtcaaatattgcggatatccactatattcgccaaaaagagccaaaaggactcggtcatgccgtttggtgcgcacgcaacttcatcggcgatgaacctttcgccgttcttctcggcgatgatattgtccaggctgaaaaaccgggacttcgtcagctgatggatgaatacgaaaaaacattgtcttccatcatcggtgttcagcaagttcctgaaagcgacacacaccgctacggaattatcgatccgttaacaaatgaaggccgccgttaccaggtcaaaaattttgtagagaagcctgaaccgggcacagctccttccaacttggctattttaggaagatacgttttcactcctgaaattttcatgtaccttgaacagcaggaagtcggtgcagggggagaaattcaattaacggacgccatccaaaagctcaatgacattcagcgtgtcttcgcttatgatttcgaaggaaaacgttacgatgtcggtgaaaaactaggatttatcgagacgacgcttgaatttgccttacaggatcaggatatccgccataaattaattccgttcatgaaggatcttcttgaaaaagaagaagctgacgaatagaaaaagctgccgaatccggcagctttttttatgtgatctttactttttagacgttaccgtcagtgtcttatcagcattgttcacagaaaaagtatattcctggtttttaagcatgagcaaattctgattgattttgctgccgcctttttcacttaaagctgagatgtctgcaggacgcgataaatgaaaaaccacttcggagactgtatcattgtcaatcactacatccgtttttgcatcggatgcttttaatacgttccgtccgtcagccgtttgtcccgcagctggatttttcaatttacgctgcacatcgtcccggcttttattgagatatgagagaaactcttctgctgtttggcttgataaactgccgctgaaatcattcagctgaacatccgtcttttttaaagcgttcactttatatagatcagtctttttcataaagtactctttatcgtttaatttcactttagccgcctggttattctcggcttctatctgcaccttcgtaccgaaacttacacttgcggaggcttttccttttatatctttttcagtgtaaaggtccgccttttcagcttttaccaaagcaggtttattcacagactcataaaggccggcatcgctctgtttgacgtcaccgaaagatgtgatcgcacgcagaggcttgtctgaaaacatcgaagcgcctgcgccgacagccagcaatgcaagcagcgtaatctgtatcgtattggcaatgaatttaggcttcgctttcttttgctgggcctgagtgattttctgttcctcggctgcccgcgttctgccttcaatctgctcgttttgatatttctttttttctttctttgaaagcttgttgaaccaatccacaaaagctttatattcttttacaacggctttcgtttcgtcgaacatacgcatttcgccgtaatgcatccaagccacccggtcacacattttctcaatctgtccgatggaatgactgacgaaaaagatcgttttgccgcgttctttaaattccgtaatgcggtccacacatttctgatagaaagtctggtcccctactgagagcgcctcatcaataataaggatgtcagggtccatatgcgccgatatggcaaaaccgagacgggatttcataccgcttgaatagcttttaacaggctgatctataaagtcgccgatatccgcgaattcaacgattttttcataaagctcgtctatctgccgattgttgagacccatcatcaagcactttaaacggatgttgtccttgccgcttaattgattgtttaatccggcagaaatcgcgattaaagacggctgcccgttcatatcaatctcaccgcttgtcggcggaatgatctttgcaagcagattggacatcgttgattttcccgagccgttgatacctacgaatccgatcgtttccccttcatagacgtcaaaagaaacatttcggacagcgaaaaaacctttttgatttctgtttgggaaaaacaatcctttaattttgtcagactgttttttatatagaaaatactgttttgaaacatttctgaacgaaacttttagtttcatcgtataatctccttactatattaaagaaagtcaacaaacttatctctgaatttcatatgaagaagtgaaccgactgttaacagcagcagtgtgacgaaccagaaatacagcgtgtatttcacatcgtggaaaaaccactgcccttccataaagctgtctctgaagccctcgataatatagaaaagagggtttaacttcaagatggtcaaaacttcaggtctgtttccaaatttctccgcaatgtcccagaaaatcggcagaagaaaaaagagaagccttgtgacggcttgaagcaaaaactgatagtccctgattaatacgctgatggttgaattaaacaggccgaaagcaaacataaaactgatcatgcaaaacaagtaataaatatattgcagccagtgaagcgtcggaaacagtccgttgctcagcagcacaataatataaatcgccatcatcacaaagtaactgaataaattcgatgctatcactacagaaggcagtgaactgatcggaaagttcattttcgacactaaatttatccgtttaaaaacgctgttagatgcatccagtatcgtcggactgataaagaaccaaggaattaagccggccagcatccagacgatgaacggtacgctgtctccatttccaagcaccatatcatgtccgccgcgaatcccgaggccaaatacgaaccagtaagccagcatttgaatcatagggttgagaaactgccacaatatacccaaatagttcacttgatactttgatttcgtttcgtacactgcaagccgcataatcagcggaaatgagttgaattgctctttcagaatttttaccaatgcattcattctaatcttccttagtcgtaagttttaggtaatagctttgacttacaaaagcaccgctcataattgtaacagattacgatgtatttttcacttcataacaagcctgagtcccatgagcgcaacatgccgtcacttaagcaaaaaagcataattaacatggttaaattatgcttttttgcacttatttacttgtccccgaaaatcacttttacggctttttcagacgattctccggtttctaaataacagaacttctcgtaaaaaggcccgaacgaatccggaagcttataatcatctgattccgtttcattgacccatttgataacgtcacctgtttctttgacaagcgggccgggcgcttctttttcaaagtcaaagtaaaaccctctgagtttatcccggtacgtttcgatatcaggcacataaaacagcatcggtcttttcagattcgcatagtcaaaaaagacagaggaatagtccgttatgagtaaatcagagaccatatacagctcacggatatcttcgtagctggagaaatcatacgcaaatccttcatacggtccgagatcaaagttttccgccacgagataatgcatccgtaaaataatgacataacggtcgccgatcgcttctctcaattggtgaaggtctaaatcaaggtcaaacttgtattttcccttcttataaaattggtcatcccgccatgtcggtgcgtagataatcacttttttatcttgcggaagattcattttttctttcagcgctttaatgacagaagggctgttatccgtctgaaggaagtcattccgcggatatcccgattcaatcatggttttattaaactgaaacgcccgggcgaatatttcggttgaatatgcgttcggtgaaatcaggtaatcccactttgaagcctctgtcgtaaagttgcgcttgtatttttcagtgtttgttccgggcatatgcacttcatccatatctacggcaaggcgctttaaaggcgtgccgtgccatgtctggacatatgtcgtatgctcaggtttcggaatccacagcggcatacggctgttgacaacccagtactcggctcttgccatggcaaacagccatttgaacgtgaagcgttcgatataaggaatccctttatctttaaatgtctgtgagtaagcggggtttacactccagcagagacggtattccggcatctctttgctcatgtattcataaatcgcccgcgggttgcagctgtactgttttccggcaaagctttcaaacatgacaagtttctgtttgacaggcagttttcctgcaaatctgaatcctgctttgtaagtgttctgtattcttttctcaatgaactttttcagcttattctttctcttgcgtacaaaggaagcgccccgtttcagcttacctttcacaaaatactccacgcgggtgctgaagctgtaatcgttcattctcaggtggagatttttcgttttctttttcgtgaaaacgtgaaatctggcaggccctttttccgttttcagaaccgtgaattggttagggtttacatgttcagatttcagaacctttaacggtttgctgttggtgataacctcttcacctgtcccggcatcttcaaaaatgaattgaatatggaattgaaagatgagctgctgattcaattctttataaacagcattcaaatcaatttttgtatcaaagcctatcgtgtcaagcatcgttgtgtcctgaacatattcatcaaggtcgtgtctcggcacgtcgtgaagcggatacttcagaatgagaggctcctcttcttttccttttttcattttcagaatcaggtttttttcttttatctttaaggtttctgccgcattcagccggaatgcaaaacctttcagatgtaagctgccgtcagattcgagctccatttcatcaatccgcgtgacgaactttttctgcagcagctttaaggagaaattccctttcttcgtcgtgtaagggaaaaagtacatatgatgagcctcatctttataagaagacagttcaataggttcaaggctggattttaaccgttttttactgatatcactgtcatcattgataaaggagacatagaaatccagacatcctttgccgtccgtatggtcagaaagcagatccgtgctcatgacagcatggtactctccgccctctccggccaaccgtttcagagggacggaaagttccgcttttgttttacgatttataatctgaagagaaggctcttcccctgcagtgacattttcacaggatatcgtaatgctgaatgtctcttcctttatgttaagatgttttaacttgtatctgacaggattttctatacccataaaataagtctactcctctgtttcaattaaacatatccaatcacaatcatcattttgttactttcagtgaaaggttctccttcaccgtccggtagaattgatattgcagtccgttcgcttctgccgtcaccttttcaccgtcttctctgtttaacatgacacgttcataatcgttataaatgacatacataatataaccgccaagtccgactttttcaatgtcacttaacgggatttcaaggacgtaccgcccgtctcccagtgactgaaccggaaactggtggtgtactttcatgttatctctgtgctgaaactgaatatattgggcattatttctgtcctgtccgaacaagcggaacgtaacggtgaatttatgatcggcgaacaccgcgctttccgtttctccgtgcatgcgaagttcgaccagtttattttcttcatccgtcagcgggctttctaaataagccagtccgtctttcgtcacgatgtttttatcgggctcttttttggaccagcggaacagcttttcgacctcatcataccgtttttgagtcagcagacggtaggctgttttatgaatcggatgaaaaaatgtctcggaaatatcgtatttcgtcttctttaacacattcagaatttcattgaatttattgtagtaggcttctttgttttcgcttttcaggaagtgcatccgatcgaaaagccgcgtaatggaatcgaattcaatcaggcggttcatcgccatcttctctttttcagtatctaattttttgttcagaatatacttcattacggctatgttcgtgtcggttttttccattatattggtctgctttgtcagcgactcattattgtccattctgttcagataatagaccggttcggttgacgttgaaatatctccgcacgccaaaagaacatccataaaaaattgcttatcttcagcaaatttcatttccggatatctgatatcgttatcttttagaaattgtaagttcatcattcttgcccgcgggcccagatgatagaaaatatgccggattgaaaaaggcgataccttcgctctgttcagcgaagactcatgtttcccgatcgttttttgaccgttcacctgcatttcgatcgtttttccgaccgcataatttacatgatctctttcaagcatgtcgaataagattttaaccccgttcggcgcaaaccaatcatccgcatccaaaaatgtaatgtacttcgcatttgccagctcaattcccaagtttctcggataagccggagttcccgtgttgtctttcaaaaagacaactgtaatattttcatacaattcggcgtactcagtcaggatgtttctggaatcatcggtagagcaatcatctaccagaattaaagaaatatgctgaaagccgatgttttgaaggatcacagaatcaactgttttccttacatattcttctgcattataaacaggaacgactaccgctaccttcttctcttccgccaatgcttctttgtttaaaatggtatattcgcgttcttctatggacggcttggactcttttttattcaacttaaaaaagttactaagattcatctttaaattctcctcttattgtctagctttttttcaaaagcgcataacaaatatagcgaaaataaccttatattacaagaagtactccctatccggagggagtacttctttatcatctgtatatccgaatgtttcaattacaccccggcaatttcttttttaatctgtgtggtggaaatgccttcggttctagggagatagatgacttcgcattgatctttaaggaaatcgaatttgccttcccaatcgtctcccattacgaacacgtcgatgttgtgatccgctacgtcacgtactttttgatcccagctgttttccggaatgacttcgtcgacataacggatcgtttccagaatcagctttctgtgttcatagctgtggtaggcctttttttgtttttgcaggttgaactcgtctgttgagatggcaacaactaggtaatctccaagctgctttgcgcgctcaagcagtttaatatgaccccaatgcagtaaatcaaacgttccgtaagtaatgaccttcttcatgaaacaaaagctcctttctatcatcatacgtataacaagcaactgccctgaaatgctgcgcagctgtatccttaatcactaaagtgccaatttcgtactcatggaacctcattatatcacatagccctgaaaaggttaagctaatgtaaaacgaagttaaattccacttattaacaaatgttattgcaataggagtttagcagggtttttgcgcggttgattaaagaaattgttatcttatttatatttttgtaaaactattgttaagtttatctgaaggtattatgttaaaataaagcttagcttaagtcacgaaaaaatgaaagaaaatcccgtacaaaaaggaggacggcagatgcagactgaaatggtgcacaacctttcttatgttaatggaaatttacaggagtttatttcatatttagacacttattatatcgcacaaaagcaaggagccgtcattgcgacggtcaaccctgagatcggatacgctgcggcgaaagacaaaggttatcatcaagtcatttcttccgcggatttcgtcctgccggatggtatcggcgtcgtgttaatgtcacgtttgacgcagcacccgctgaaatcaagaattgcgggattcgatgtatttctgtcgctgctcggtctcgcaaaccggcagtctaaaaaaatatttttatacggagctaagcaagacgtgcttgacgccgttttgaaccggatcggcaaagagtatccgaatattgaggttgtcggagccagcaacggttatgaagcggataaacgcttcgtcgccaaacagatttcccgggcgaaacccgatctcgtgtttgtcgccttaggatatccccatcaggaacaatttatttatgaatacaaacatcttttccctcaggctgtatcgatcggtttgggcggaagctttgatgtgttcagcggaacggtgaaacgcgcccctgaatggatgatcaaaacgaatctggaatggctgtacagactggtgacgaatccgtggagatggaaaaggatgctgaacattccgaagtatgcttttaccgttttgagaaataataaatcaaataaaagcctgtattccgagcaggcagaagatcaaacgaaacagctttaaacaaataaaacagcaaaagagattggtaatctatgaacttgcgatctttattcgccgctttttattctatatatctgtctgttctgggcgttttgttcaagcctgtaaagcccaagaaccatctgaccctgctggtatcttttgaagagaatgcacaggctctcatccgttcttacaaagcgcacgctgaatcgctttcttatgaagtgacggttttgtatacgagacacgccgtcagtctgaaaaaagagctggaaggactcggctctttttatctgaacgaaaaacatccgctgcatcttttgaaggcggttttgatcctttttaagagcaaagcggtgataacggataactatttcctcatgacaagcgtcttaaaccgccggccgcaaacgacatgtattcaagtgtggcatgcgaacggctctttgaaaaagttcggccttgaggatgtgacgaatcaaaaccgtccggcatcagacatcagccgttttaaaaaagtgtaccgctcgtttgactttgtcaccgtcggttcagacgcgatggctgacgtttttaaaaagtcgttcggcatacgggacggccagctgttaaaaacgggtgtccccctgactgacgtctattatgaagaacacaagcccgaaccgaagcacaaatggccgaaaaaaatcatcctgtacgcaccgacattcagggattatgatatgcagtcctttcggctgccattcaccgaagaacagctcacaaacgcgttaaacggagagtatatgctgcttgtaaagcttcatcctgccgttttgcatcatatttcggcttcgtttgaaagcgaattgatcaagaacgtgtctgacatgcgtcttcatgatctcttgaaagcggctgatattttaattacggattactcttccgtgccttttgaattcgcgctcttaaataaaccgattttctttttcacgtatgatctggaggaatatgatcgaaaacgcggtttaatcgacaattatacttccgtcattcccggaaaggcttgtcatgacagtgaagctcttttggaggaaatgacgaaaaagccatttgatgcagaagaaatgaagcggttctcggacaaatggaatatgtattcagatgggaattcgagtgaagcgttattgaaatttgcggaaacaaaaatgaaaaattgtgctgaagcacctgcctgaatctgaggcgggtgttttttgcatgaagaaagggctgaagcatacacttcagccctttttttatactttcatatacacgggaacatcatagtaaagcgtatagtcatccagcagtgagtataagctgtacatgcggtttacctgcttatacgcccagccgatgtctgtcgcatactgatgagccgcggctggagaccatctcattttatacagcgtatcctgctcgtatgaaggattgtgaatataagacgcaccgataaattgggctccgccgataatcgcggcttccggagtaaaccagccttgcttatacgcgtattgtgcgccgtagtaattcgggttgctgtcataagccccgatgccgtacatgttgtaaacctttttaccattatacataatgccgttcgcaagctctgacgtgccattgcccgtttcaagcaaagcatgcgaaatcaaatacacttcattaatgctgtatttgccggcggctgtaataaaggcctggcctttccctgtcagtattcctttattgaccagcactttttgattcagttccgatgcgttcagtccggctgtctgagagagcttcagaaattgaaagtaatacttgctgtcttgtgcgaagtgagccggattgacgtactgcccgacttcgtcactgctggcgtttctccagcccatgctgagtttggcccagccgtttgtctggcctgtgatgctgactttatcgccttttttcaactgcccgataatattgcctgagctgacttccggggttgaccggacgttcaggacgtcggctgtgaccgttccggaggccgtattgatgtacgtaagcgatgcataagccgcggcatcagtctgcgggctgactgtcatttgttttttgaccatatctgccagcgagatgttgtaattggtgttcatgatttgcggtccgttttttattttcagaatagccatcgtccatccgtacagctttttcagcttttgggaggcggcgtccgctgactgcgctcccgtgaattgattgcgaatgcggagttcataaaccggatggctttcactcgtatagccggcctgtaattgtttggcgctgaaaaagctcatgcttttatttaaaacggttttactgctgaatttttcggttttgatgacgtattgtgcagagccggttttccccgtctccttcacagtgccggccgctttgttttgcttgaaaaaagcagtcacgcggtcaatgtcttccttcttaagcagcggtgccgtttcaattctgaattgtgtatacgccgcttcacctgttttctgtgcggaggcggatacttttttccctttgaaaaaatccagcgattgattgatctttgccgtatcaagcagtgattcggttgtgacttggtacgttgtgtccgtctgcttggatatcgtttttgaaatggcagtcagtttatatcccgccagcagattcaatcctttttttatcttcgactggtctgccgtctgctgagaaagcagctgatattcgttttctgctgtttttcccgccgctgttcttgccgtctttacatgctgctggcggaaaaacgcctccgtttgatccgcctttgcagcggtaagctgccctgccgtgatccggtaaacggacactgatgctgtctttttgacaggcgatgcgtcgcaatgccattttttctttttaaagaaagcttgcacgctttgcagctgtttagccgtcagtccgctcatcgcgaccgtgtaattattcttcttgccggctttttgatagcttccgctgacacccgtattcttcttgatttgggtgatagcattttgtacggcgcttactccgttaaaatatcctgactgcacgttatacacggttgctgttttgctttgggcatacttttgaacgttccctttgacgcctgttttctgctgcagctgtttcgctaaacctgccgcattatttgcatttaaaatgtcagaggctgtcacggtgatattcggactggcctttgccgtgactttcagcgacgactgcaatcctgtttccttttgaaaatcagtttgaatttgagcggctttttgatcgccggagattgttcccgattggatctgaaaccgggctgtttcccgtttgatctgacggtatgacgctttcacgcccgtctgcttcgtcaacgcttgcgagagcgcttttgcatccgcatcggccgccatctcagaagtcacgacctgcttatacggctgttttgtccccgccggcttgacggcgccggtcacgcccgtttttttcgtcagttcggcaagaagatttttcgtctgccgctcgtctgatagaacgcctgatgtgacggtcacgtacggctgtttgcttccgcttgcgctgtaagtgccggccacgcccgtctgcttcgtaaaatctttcagcacggttttcgcatccgtttcatcgtgtaagcctgaagctgagatttgataagtgagcggcgcatttccggctttctttgcgtcagcctgccaccccgtatcctttttcaatttcgctgccgcttgaagcgcctcgttctcagaagcaaattgctgcttcgtttccagctcgtaaacggagtagtcgctgtatgcggcctcggcgtgctgtgtaacggtgctaaagacaaggaaaacggcggacaataacataggtgcaacgaatctctttttcattccttctcctctttctgattcaattggtttctatcaaactagtttatttatcggcccgctttcttcatttttacagagagaaatcatccaattatccaaataaaaaaaacttaatcccagagctgggattaagtttggttttatatatgagaaacgatgatcgtgcaatctccgtttatcgtaaagtcaggcatctgatccggcagtatgaaatgcgcgcctttttcaagcttggcggacttgccttcaaagatgatggagccgcttccttctgtgacgctgcataacataaacggagcgtcctgggtcatttccgccgtcccgctgatatcccatttgtatacagaaaaatattctccctgcacaaaggttttaatggtgatgccttttctcgtttcagttgattcatccaaaaatccgtccacatgaggaacggtggcggcgttgacggcatcgcggatatgcagctcacgcgcaccgccgttttgatctgtacgcccgtaatcatatatccggtaggcggcgtctgaattctgctgtatttccagcacgagcgctccggcgcaaatggcatggatggttccgctcggcacataataaaaatcgccgggtttgatcttcacgcggcgcagcaggccttcccagtcaccgctgttaatcatggtgacaagttccgctttcgaacgggccgtatgaccatatatgatttccgcattttctttacagtcaataatgtaccagcactcagatttccccgtttcgccctgtccatgctcctcggcgtcataatcgtcaggatggactttaacggacagatgatgtttggcgtccagtattttagtcagcagcggaaaccggtccccttccgttccgccgaataactctctatgctgatcccacaggtccatcaaggttttcccttgatacggaccgcttttgaccgtgctcattccgtgcggatgggctgatatcgcccagcattcgccggttgtttctgaaggtatgtcatatccgaatcgttcgcgtaataacgtgccgccccatattttttctttacatacaggctgtagaaaaatcggctcttgcgtcatgttcgttcccctccccttaaaaagcggctcatatcccattccccctgtgtcttttttaaaacacggagggagccgcggttaaaaacaatatgtataaaatggctgacctgctcattataccattcggatggggcggaatgctcagtcatttcctattccagaataaaatgccttgtttgtcgcaaattaaaataactgatggaaaggggggaacattatgacgatacatgcggagctcggcaaaaaccttgaagcgctgaaaaaacggatcggccaaagcgatgacatgatgttttattcgtttacgtacggaaacggcaaatgtgacgcctgccttatatatatagacggactgaccgacaatcaattgcttgcggaatatattatttcgcccgtgcaggcggccgccctgcatcaagaggaaccggctgaaataccgccgtcatccatctctttcggctatcgtcacacccggctttcttcacttaaggacgcggaggcagacattttttccggcaaatcggttttgctggcggagggatgggaggaagccctttcgtttgaaacggaaacatttaaaatgcgtgatattgaagaaccggcttcagaagtgcttgaacggggacctaggataggttttgtcgaaaagctccgaacgaatacggcgcttttgcgcgagcagtccggtgatcccaacctccagatcaaagagatcacactcggcgaacggacaaaaaagcggatcgccgttgcctacattcgggatattgcgcctgatgatgttgtaaaagaagtgatgaaaagactggattcgatcaccattgatgacattccggaatcaggaacgatcgagcagcttattgaagataacacgtattccattttcccgaccgtcttgacgaccgaacggcccgaccgggttatgggcgctcttttggaaggaagggtctccattcttgtagacggaacgccttttacccttttggtgccggctaccattgatgaatttatccactcacctgacgattataatcagcggtgggttccggttaactttctcaggctgcttcggtatacatgcattttaatcacgatttatttacccggcctttacatatcgctcgttacgtttcacacggggcttttgccgacgagaatggcggtgacgattgccggaagcagattgaatgttccgtttcccccttttgttgaagcgtttattatgatttttacgattgagatgatcagagaagccggactcaggctgccgaagccgatcggacagacgatcggcctgatcgggggcgtggtgatcgggcaggccgccgttcaggcgaacatcgtcagcgcgatgatggtcattatcgtatccgttacggcattggcttcttttacggcgccctcctatgcgttcaattttccgctgagactcatccgtattttttcgatgattttgtcggcgatattaggtttatacggactgatcatgtgttatctgcttgtcgtcggccatctgatgcgcctgaaaagcttcggccaggactatcttattccgatcatggcgcagccgggacaggacttaaaagatacgatcgtcagactgccgacgcctcttttgaaaaaacggccgaccagaaaagagacgaaagataaaatcaagcaaaggtgatcaccatgaaaaaaccggaagacaagctgtcgtttatgcagacacttctcatggtaagcggaacaatgatcggagcgggcgtgttaacactgccgcgctccgccgcagcagcggacagtccgagcggatggatcattattcttgtgcagagtctcgtgtttatcggcatcgtcctgctctttatgccatttttgcagaaaaacagcggggaaaccatttatgagctgaatcaaagcattatgggacgcgccatcggttctcttcttaatttattcatcagctgttattttgtcgtcaccgtctgttttcaagcccgttttctcggtgaggtcatcaattactttttactgaaaaatacgccgatgggtgtcgtcatattcatctttctggcggtcggcatctaccatgtgaccggcggggtgtatcccatttcaaaactctatgcttatctctttccgattgcgatcgtcattctgattacgctgctcatattcagcctgagactgtttaaactggatttcatccgcccggtcatggaaggaggctacaaaagcttttttgagctgtttccgcgtacccttctgtatttttcaggacttgaggtgattctttatctggtgccgtttatgaaaaatccgaagcaggcgaaaaaggctgccgtcttcggcatcgcatgcgcaggcttattttacagctttacgctgcttgtcgtaatcggctgtatgtcgatcgctgaagccaaaacggtgacatatccgaccatttccctgattcacgccttggaaatccgcggtattttcatcgaaaggtttgatatctttcttttaattacgtggacatgccagcagttcacctgtatgctcggttcttttaaaggagcgcatctcgggttaaacaccattttcagactgaaaaataaaaacaatgcctggctgctggggggcttattggcagtgacattcggcctttcaatgtaccctgatgatatcaacagtgtgtttgcattcgcgaatattctcggatatgcgttttttgccgtcattatgattccttttctcatctggtttgtcagctggatgaaaaaaatagccgggaggaaacagacgtcatgacacatttcgtaaaatgggcggcggcgcttttcatactgatgacgctttcagggtgctgggatgcgaaggaagtcgaaaagctatctttcgcccgggggctggcgatagacgagacgagtgaccgccgatataaattaacctatcaaaacctgctgccccaaagtgaaaacagccaggcttccggccggcccgtgtttgtcaatgtgacgtcgcggggggataccattcttgaagccgtcagtgaagtcgctttaaaagatccgcccgtttacagcgatcatttaaaagtgctgatattcagcgacaaattgctggccgaccaaaatatactgcagatgatgaaccattttatccgtgatgatgaattaaggcggagcagctatctcttcgcggcaagaggcaaagcggccgatattctgacagagccgacgccgaatcagcagcagcccatgcccgcggaaaagctgatcgaccttacgaacaacggcggctacaacgggaagattttaaaaccgctccgaatcgggagagcttcgatttactgccataataaactcagttttctcattcaggccgtcagcaatcaaaaaggaaaaacggtgtatgacggagcggccattatcaaaaacggaaaacaaaacagattggcaggctttctgtcatcatacgaagtacaaagcctgaattggctgacggggacgatacagggcggcgtgctgcccgctttggataaaggagggcacccaattaccttcgagatcaaaaaatcaacatcctccatcacccccctgctgaaaaacgggaagctgtcgtttcacgtagcggtgaaaacaaaaggacttttgtcagaggatcaatatgccggagaagattcattcgatcagcactatttaaacgggctggaaaaggttttcgaaaaaaaactgaaaagcgatatgaaagaagtcatcgataagctgcagaatcaatatgaaacggaccctgtcttcttttctgacagagtccgcattcaatatcccgactattggaagaaagtgaagcatcactgggatgaaaccttctccgaagcggcctttgactatgatgtttccattcagattaccaacttcggaacgatggggcggtagccttcagcgtgttttttcgacacgaaggagaatctgataaatccggctttgttcgggcagctgtgtcaccggaaattgcatcgattgcgccattcgtgtgatttcctgtaaaaacagctgcacccgctcatccacgtgaacatacgtataggactgctttttcacgtcaaatgtctcttccggaaagagcgtgcgcaccgtctgcggcgtaaaaaaccgcaagtgggtgcggtcgagaatcccggcgtctctgtatgtccagtccccgagcagaagcgggaacagcgcttcggcgtgggaaatattcggaatgctgcaaacgattgatccggcaggcgacaaataggatgagtacgtttcaatgacgcgccacgggtcttttaagtgctcaaggatgtccgcgaaaatgatgcaatcaaaaaagccttccggataaggcagcttcactttttcgacatcttcctgcagcaccgcttcataatgtccttttgccgcttgcgccgccagcgggtgcagttctattccgtacagttcgcaaggctgtctgttttgaagttccagccccgtagctcccgcaccgcagccgacatcaagtatccgtttcgcctcccggggaacgagctccgcaatttccggtctcggatgagtaaagtacgtaaaatcagtgccccatttttccgtaaaacgctggcggttctccgaatataactgattgatattgatatcctgattagccgtaaacgtcgcatgcccgtggtgatgcacaaaggcatcgagagcgatgtgcaggctgtatcctttttgcagggcgcgcagacataggtcatcatcttcaaaagaaccgtatccgaattgctcatcaaacgggccgatgtcttcaatgacgctttttttcaccagaagacagaagccgacaaggcgcagcacccgctttgtttgatgcttttcccgtgcacaatacgcctccgcgaatgactccagctcatcaagcgattgatacgcgtcatggatcatttgcgcgccgctgacatagttgctgacgggcccgaccataccggttttttcagattgatacagcaccctcagcatggaggtgagccaatttttcgtgaccatcgtatcgttgttcagaaacagcagattttctccccctgccgcttcgattccctggttgcaccccttggcgaacccgaggtttttttcattaaggatgactttgacgtcaggcagatttgatatgtattctctcgttccgtctgaggaaccgttgtcaactataatcagttcaatcttatctttgtcggtgtatcgttcaatgctggccagacattttttcgtcagctcaagttcattatatgtaaggataataatactcgttttcaccggcatccccgcctttatcgtgactttatacaacgtatgacatatccccgtcatttatgtgaccgtgcgggcgcccgcacgcatccgttttgaggggccggtgaataaccgcccccctaaaactgaatattacggatgaactgtccgccgatttgattctgatcccgagcctccgttacggcttttcagatcctgctcaatttcttcaaggcttttccccttcgtctcggtcactttaaaccggacgaacaggaatgccattattccgatagcggcataaatgagaaataaatagctgatgccgactgcttccattagcatcggataggttaatgagacaatcaatgttccggcatgcagcatcaaagtggagacacccgtcccgataccccggacatgcagcgggaataattcaggaagcatgacccacacggcaggcccccagctgaccgcaaacacaatgataaacaggcctaaacaaatcaccgttgtccatgatgcggctgctgaatgttcaaagaaaagattgaccgcggccaatacgagcagactgatgaccattcccgcatttccggccagcagcagcggcttccggccgatcttatcaatgactttaatagccgcaagcgtcatgatgacattgacggcgccgattccgaccgttcccaatatagacgcggaattgccgaacccgacactggtaaatgttttcggtgcgtaataaataattgtatttgtcccgatgaattgctgcaaaaaggcaagtccgaggccggcaatcagcgcgggtctcacccacggctcaaacaattctttcaagccgccttcgttttccttttccgcttctttcatctgatcaatctcatcatcaatattcttcgttccccgcaatgatgaaaggatttctcttgctttctcttctttgccgatcgtaaacagccagcgcgggctttccggcataaataagattccgatcagcagaatgactgacggcacaaccgcaagtccaagcatccagcgccaagcgcctgcatcggcaaatatatagttcacgatataagaaacgaggattccgaccgtaatcatcagctgattcagcgaagaaagcgccccccgtttatgcttcggagccagctccgataaatagagcgggacgatcgttgtcgatgttccgacagccagtccgagaataatccggaaaagaaccatcacctctgtattcggggcaaaagcgactcctaatccgcctatacaaaacagcagcgccgctcccatgatggccttccgcctgccgaaccggtcggtcagtttgccggcgaatcccgatccgagaatcgcccccgccaataacgaactgacgacgaggccttctgtaaaggcgttcagtcccagttcttttttcataaataaaatagctccggaaatgactccggtatcatatccgtataacgcgcccccgagagcgccgaaaaaatagagccatttattcgagtgtatgcttttcatgttatatagactcccttcatccaacgctgtatccgcgcggaattgttctactgcttcttttgcctgtttccgatcgtttcaaaccttccgcaccgttaatatccattattttactgattatttttcacaaagcgacgaaacatttcccgcttcctgccgtccaatataatgtgaacctgatgcaaaaataacagtagatgttgtcgaaatagagagaaagatttagaattttctcatttgcagagttgctccgagtcaacaattatggtacgcttcacaaagaatagaaacgagaggtaatgatatggaagaacgatctcaacgcagaaaaaagaaaagacgcctcagaaaatgggtgaaatttgtactggtattcgccgctttcttattggtgatcgccggttccgtcggcacctacgcatttgtgaaattgaataatgcgaccaaagaagcgcacgtcagccttgaccgcggcgaccagtccgtaaaacggatcaaagaatttgacccgaagaaggattctttcaccgtattgcttttaggaatagacgcccgtgacaataagggtgaatcagtagatgacgcaagaagtgacgccaacgtgctcgtcaccttcaaccggaaaaagaaaacagcgacgatgctcagcattccgcgggattcctatgtcaacatcccgggacacggctatgacaaattcgcgcacgcacatgcttacggcggttataatttaacttataaaacagtagaaaacatgtttgatattccggtagattatgtggttgaaagcaacttcgacgcgttccgcgatgtcgtcaatgagttgaacggcgttacggtaaatgtgaaaagccagaaaattgccgatcgtattaaagtcgatacaaaaggaaaagtcgtgctgaagccgggcgtccagacgcttgacggtgagcaggcactggcttatgtaagaacacgcaaagcggacaccgatctgatgcgcggacaaagacagatggaagtgctgagcgccattattaaaaaatctaaatcgttaagctcgatcccatcttatgacgatatcgtcgacagcttagggaaaaacttaaaaatgaacttatctcttaatgacgccatcggtctgttcccgtttatcacatcgctgaaatcggtgaattctttgcagctgacaggttcagacagctacatttacactcctcagtacggcaaaaatatttattacttcaagctgaatgaggaaaaccttcaagaagtaaaaacgaaattaaaaaatgatttagacgcgtaagatgtcacggcgggattagcaaatcccgccgtttttctgttgaaaaaaaggacatgaaggtatagccttttaactgacggctttctgctgatttcgcacaaagctgaacatactacatgaagcagctttatttttaaggagggcatccatacatatgaaattgatagccattgacttagacggcacattactgaattcggacagtgtgatttctccggaaaacagagcggctttacaaagagcggatgaagcgggcattctcgtggccatctgcacgggcagagccacgtttgatgtaaaagcgctcttgaaggatttggatattccgatcattgcggcaaacggcgggacagtccatgacaaaggataccgcctcgtcagccggctcttaatggatcagcaggccgggaaggatatcgccgcttatttaacggacaaagacatttactttgaggtctatacagatgatcatctgctgtccccgtttgacggcgagtccaaactgcaggcagaactggacattctgaaaagcgccaatcctaaggaagatattcagacattatgggagggcgcaaagacgcagttcaaacaattcggcattaaacccgtacaggatatacaggcgatttttaacggagacgaacatgtttacaagcttctttgtttctcttttgatatggaaaaactgagaaacgccaaagaagaaattacacatcatcggaaattatcccagacatcttccggaaaacacattatcgaaatcctccctgccggttccggaaagggacgtgctctgacggagcttgcctcactgtacggaattgaaaaacaggatatttacgccatcggcgacagcccgaatgatttctccatgtttgaagcggcgggaaaccgcatcgctatgggcaatgcgattgatgaactgaaagaaaaaagcacctatattacaaaaagcaacgatgaaaacggcgtcgcatatttcatcaaccggcttctcgacaatgggcaataaaaggtaaaagtcaggtctttcacggcctggctttttcatgttttctaaaaaaggagtttcatgatgtcgaatgcaatcgctattataggatttttagcttttctctgcgcagtcggatacggaatttttcatctcatatgcaaagcggcaaaaaaagaaaaacatttttcaaaaaagctgttttggcctcttctcatcggcggatttatcctgcttctgaccggtgcatccctcgcagagccggacgcctcggccgtgaaggcagaggagaaatacagcacccttgatacggcttatcaaaaattgacgaaggaacaccaggcgcttgagaaaaaatatgaaagcatcagtgccgcagccgaaaaggagaaatccgaagctgaagccggcaatgaagaaaaactcagcaaactcagccaagagataagcgagctgaaaaaaacaaacaaatcactcaaacaagacaatgagaaattaaaaaattcacaaaagaagctcgaaaagaccgctgaaacgcttcagtcagaaaataaaactttaaagcggcagaaagcagaaacaaaaacatccgaaaacgcggaaacggcgcaaaacaacgccccttcctccggaggacatgccgaaacgaaagcagccggcacctcacagggatgcgacattaaaggcagccggtacggcatttatcacacgccgggaagtacgtactacgaccggacgacagatcccgcggaaatgttctgttctgtagaggatgcgatagcggccggatacagagcgccgaaacggtaaaagaaaaagacgtcagagacactctctgacgtctttttttacggaagccggatgccgcccgcatatttgtccttccaataagcgcttgtgttcatatttgttatggtaacacctgcggacacggtgacatgaatcacttgtccgttcccgatataaatggccggattcaggctttccgctttaaagaagaccagatcgccgggcttcagatcttgtttatcgaccggaacgcccgcctgcatctgcttgtcggcataacgcggcaggctgattcctttcgctttttgatagatgtattgaacaaatcccgccgtatcaaagccggtttccggtgaagcgccgcctttcagataagaaattccgatatgatcggccgctgtggacacaacgggattgtctttagaaatggctaaattgctgaatcggcgcacccctgtgaaatgttttttccaataatcttccgccaagtaagaaatggtgactttttcggagcggcttgcttggatgaaccttccctctcccgcataaatgcccgcatgggaaattccttttttatacgtatcgctgaaataaatcacgtccccgggctttatgtcgctcagtttgattttctcaccgaccagccactgctgttccgcagatctcggcaggtaaatgtgaagcttgttttcaaaaacatattggaccagccccgaacagtcgaatcccgcctcaggcgtgcttccgccgaatacatacggaatgtcgaggtaacgggctgcctcctgaacgatcggatcatcagccagttccggatcttttgtcatccgctttgcgccaagatataaattcatccaataactgcttttttgaaagcgtgtgacggttacgccttctgacggagaactgtgtatcatctctccgtttccgatatacagaccgtcatggacggccgcgttttgtgttgaatctgactttttgaaaaacacaagatctcccggtaaaaggtcattttctttgacggcggctccgactttccattgatcactgaccgttctcggcagatggatgttctgcctgctgaaaagataatgcatcaatccggacgggtcaaaaccgtcctcaggctcttcgcctccgtaaacatatttatttccgacaagtttttgcgcgtctgaaacgatcaggacagaaacttgagaatccgcttcggcaatttccgttctcgttactgcaggtgccacaagacaaatcataaggccggcaaggatgtacttcctccagcttgtgagcatgttttctattcactctcctcatttttagtagtttttacatcggtaacttttaacaaatgtttaggagagcacacaaaaaaagaatgcccgatatgggcattctttactggattcggaacaaacaatatgccggcaagcggaatcatgcgcttattttgcgcccgctgtgtcctcttgctgaattttttgcatttccgtgtcaattttttgtttttcctgatctgtgagctgatcattgtatttaaacgcagacataaacataaataccataatgatcgcggcaaacggccatcccgctttaatgattttcatttgtttttcactccgctttcttttttaagatatcgctgtgatccacatcaaacgttaattttccatccttgacgctccacttgaaattcgattctttcgtcagttcacgtacgatcgttttatgattgatgctgccttttttaaccggtgcaggcgttgcttcatgaatgttcatcggcgtgacttcaaagcgtcccgtgccgtttttctggagatgatattgaacaagcgccgtgtctctcgttcttgtccacccctggtcgaatacgaagttgcccaggctgtagaaaataacggtgccgtggtacatttcgatcggttccagcacgtgcggatggtgtcccacgataatatccgctccggcatcggacattgctcttgccaattggcgctgtctgtcattcggatcattatcgtattcctgtccccagtgtgtttgaacaatgacaagatcggctttctttttggctttagaaatcatcggaataaacagctctggatcggccggaagcacacccggcgcatttcgtttagctgcaaaaccttttccggaaacatcagtgaaacccagtgttgcgattttgattccgtttacatcttgataagaaatgttctgctcggcttccttcagcgtgaggcctgctccgacaagttcaagattttgctttgaaaactcttcaaccgtatcccgcattccttgagggccgtaatccatcgcatggttgttggctgccgtgagaactgtgaaattcatgtccttcaatacttttacggcatctttgtttgactgaaggtggatatttttttctgcttctttgtagttctttttatatgtaaccgggttttcaaagttccctgacacatagtcggatgattcgaagaatggctttgcataacggaagacactctccgtgcctttatgctttgtcactttctcgacattccggcccatcataatatctccgacaaatgaggctgatacaaggtcatcggcatttcttttcacactcggcgtttccgccttccctgtcaggatgcagacgaacatcaggcaaaagacgattggcagcgcgataaaaacgtgaagattggtcttctttttctgctgtttggtcagcttcagcagtttttcttgaaagcttaattgttttttcatcgtttgacacaccttacattagattaagtagtaagcaaacataatggcaaaagttgcgccgcttaagaacagcgtgctggcgaaagtaatcgttaatccctgtttctgaatggtattggcgatcagacccggtacgatgataccgattccgcggaattctgatatctcaaacggtacgatcgggtaaagaaaatcaagggcgatttttaagcagattcccgttatcagcatagctgcgaattttctgcgtccgtacaatatcataaatctggataaaccgtatttgacgatcacgtatgtaagaagactcaccagcagtacgagtaaaataaagaccggctggttaaaaacgagccctaaataacccggcacaactaaaccggcaggtacgatacctgttttttccgcgaaaattaaactgattaacacgcctaaaataagtgaaatgtataaatctgatccgaacatttatccttttcctcctagctaacgagctgtttcaccttatactcttggattttttcaattaatggttccgctgaaccgtggatattgccgacgccatatatgacacggttttgcattcttgttttcagcacgtccatgatttcgtctgttgatttatattccagatcgtgcagtgtatcggcaggaatcttgccttcttcataagctctgacgatcggttctgtcgtctcgccgatgagtatgagttccttcgttttaatgtacggaagcacgtcgtttgcgaactgaatcgttctgtccacacggtcggcgcggcagttcatgatgacgatcggttcatctgtcgggtagccgatttcctttacacgtttccatatatttaaagtagaagatgcatcatttgcggcaaagccgtttacgaaatgaccgggctccttcgtgctgagcagcggcaggattctcatggcgccaggatcaggcggcgcgttcagcattcctttaaacgccgtttcttcatctatcccaagagcctgggcaacgccgagcgccagggaagcgttatcaggaaagaccatatattcaaattttcgaaggtattcatctgtaattttagagttatccgcaataatgacctcggtattccgctctgcggctttttctttaaagaagtctgtgtattcactgtctgtaatgacaaggtgaccgttatacggtatcgtcgcggtaaaagcttcagcaatctcatcaagcgtcggccccatgacatccatatggtcttcaagcacattcacgatgacgccgatgttggcttgaaggagttcttcctgaaagataatctgataatccgggtttactgccatacattcactgacaatggcattggcgccccgttctacggtttccttcattacttctttttgctcgccgatattcgggccctgcggtttccgtttgatcggtttctcctcaggtgtatcccaatagatcatccttgcatctgttcccgtcgtttttccgactgttttgtagcccgcctccatcagtattccggtcgtcagcctcgttacggttgactttccgcggataccattaatattgacgcgtactggcagagcatcgatattcttctgatgccgccttttttcaatgattccgatgattagtacggcagcacaggctataatgagtaaccacattgatttttgacatctccttctgtattgataaattcattcatcagtatatagcttcactatgaattctcaatcggcattatgtaacataatcttcccgctttcactgagccaaacttctctattagtgacgctattcttcctattatcgaattgctttttttgggaataggcaggacttaaaccttacttcaattttttaaaagaaaaatgtatgcgtttacatttccgcacataaattcatttggaccaatgggactatacgcgttccggaagaaaaagatgtaatgataatccatcttttacagcctgttatatcagcgttttccgcactgcgcatacgtttcgggactctatgtccgctgtgtgcagactgcctgttttgttaaggataaggtcttaaagtcattcatttttcccccgtatcctgctttcagtcccattccaaaataactagcggaatgactggtacgtgacagaaaaagacgggtccggagtgtttacaagaaatacacattttatatgcggaaagcctatctccttttaaagcatttacaggacatttatcactcttttgaaataattttaataaatctttatattcgttcaagaaatattcatccataattgtgaagttcttggtaaaacgtcgagaaactcctctattttataaaatgcataaaaaaggaatacccgctgaaaactacaaataaccgggaaaggaggcggtctgatgtctgcggataaacaaaacaagcggatttccggcgattttgaatcggctgtacgggaaatgcaggagctgatgtgtgtttgcggtgattttaaaatacgaaggatcaaactgcaggaccgtcataccgctttcttttatattgaacaaatgatagaagaacagaagctgaatgagtttctgttaagcgacaccctgcagaacggtccgcttgaggaaacgatgaatgccgtcagcagtgcggaaacggatgaaaccagaaaactcattgacgggattttggcaggccaggttgtttttctcagcgatgcatcaaggaaagcgaagctgttttccgtcgggcagaatccgctgcgttccattatggaacccgaatctgaaagtatcgtccgcggcgcccatgacgggtttgtggaaagtttggaaacgaacattcatcagctgcggtttcacatacaggaccgccatctctccgttcattatatggatatcggggaaagagccaaatcaaaggttgcggttatctttgttgagaatatcgccaatccggagattgtggaggaagtgaagcggcgcctgtcatacctgcgtatagacagcgtgcttgcgcccggaattatcgaggagtcgatagaagataattcgttttccatttttccgcagatcgttcatacggaacggccggataaagcaaaagcatgcgtgatggaaggctgtgtgctgatcatgatggatggcagcccgtcggccttgattgcgccgatcacgttcttttccttttttcaatcgccggatgactacagcacgaggtggatttccgccagttttttgagagtgctgagatttttcgcctttatgatcgcgattacactgcccgctttttatatcgcgctgattgcgtttcattttgaagtcattcccaacgatttgattatcaccatgaaaaattcgattgttgatattcccttccctccgctgatagaggccatgattatggagattacgattgagctgatccgcgaagccggtatcaggctgccgaaaccgatcagtcagacgatcggcattgtcggcggtctcgtgatcggtgacgcagtcgttcaggcgggactcatttctaatatgatgattatcgtcgtggccgttacggccgtttcttcttttgtgcttccttcatatgaaatgagcacgtccattcgaacgctcagatttccgcttatgtttctggcatcctcgttcggttttatcggcatcgcattcggcttcggacttattctgatgaacctgtgcaagcttgaatccctcggcgttccgtatttatcatctctgacgccgtttcatttcagtgacttaaaggatgcatttatccggctgccggcctggtttattaaaagaaggcctttttatttgagaccgcaagattcaaagcagataaaacatgttcgggggtggagaaaagatgaagcctaaaaaaatcagccggcttcaaggcgtgtttttcattaatcagacgcagatcagcatcggcattttggcgctgccccatttactgatgatgaaatcgggaagcagcggatggatttccattctgcttaccggattgctcgtccagcttaccttcagcctgtatatgatattatttcaccggtttccgaagctgaacctgtatgaaatgctggaggaggtgttcggaacacttgccggcaaaggggtgcaggtgctgtatattttatatttcgcgtttctctgcacgctcattctttctgtatttacacggttattggatatctgggtgctccctcagactccgaattgggtgatcagcttaatgctgatcctcggttctgtctatatcgcccaagccccgctgaatgcgatcgcgaggttcagctttattttaacgccgtttttgctgctgatctctctgccgcttttatacacactgggaaaagccgatatcacatacattatgccgatttttcacggaaccgcaaaagacatgcttaccggggtgcagcaaacacttgtcagcattaccggctttcaggcggcgcttgtgatcgggccccttatcaactgcaccgtcagccagcgctacaaaatactgacgatttcaaacggcttgattatcctttattacctgtatatcactcttacttgctttgtcaccatcagccccgaagaaataaaaatgatcccggagcctgtgctgtacctgttaaaaaccgtttcattcagaattatcgaacggacggatctgctctttttgacgttttggttcgtgaccgtcttttcaacgctggccaacgtgttttacttggcaagcaccggcatcgccaagctgttcaatcaaaaagatcacagccggtttgtttatccgctggccctgctcgtcttccttctgtctatttgggccacaagcacagataaaacgatacagcagctggatcagtttttccgcatttccgatattgtgtttgtgtatttgtttccgttgtttatggtattgattgtccttgtacgcaaaaagggtgtccgccatgcgcattaaaaaagcggttcttatcagtctcatgtgcgcaagcctgacacttgccggctgctgggatcaaaatttgttgaaagatatttctctcgtgctgaccgcaagccttgatgttgatcatgacggtaaaaataaaatcggcattacctatcggaaggttcagtcctcccaggcggaacaggaaacgggcggctcattcattacgacggtgctcagcgcttccggacacaccatccgtgaagcgcggtttcaattggataagcttgtcgaccagcgcattgacacgtccaagcaaagagtcttattaatcggtgagaaaatggcggaaaaaccgctttttccttatctcgatgtcttttacagagatccgaaaagtccgcttctcgctcatccggcggttgtaaaagacggcgaggcgattgaagtgctgaagctgatcgtccggcagaaattgatcgtcagcaagtatttaacgaatttattaacaagcgctaatgcggaatcaaatatcagcatggaaaatttgcaatccatccgttcaagcatgctgacggctgataaggatttcgcccttccttatttatcgattaacggacagacgataaaggtagagggttctgccctgttcagcggacagcggaaagtgactgaggtgctcggtcaggattcgaccctcctgacccttttaagcgggcaatttaataaatcggctaatattaatctgaagctgtgggacaaatacaaaatggatattgaaaattatctttctctcggcatcacggatgccacgcgaaagattgtatttatagatacagatccgcagcatataaaagtgaaaatccgtttaaagctgaatgcacgcgtcttggaatatccgaaggacaaactgaattcttatacggcaatcgaccaaatgaacaaacaagcatcagcaaatttgaacagccaggccagatcggtgatcagccatattcaggagcacaactcggatatcctcggcatcggccggaaatatcaaacccattattatgagcggggcaagcggctcaattggcgtgaggtctatccttccatcgagataatccctgatatcaaagtgaatatctcgcaaatcggcatcgtgaactaaaagagaccccggtctctttttttgttgccaaccgaaatgattcgtggtactctttttgtgtaaacggttacataaatgaagggggagtgtttgttggtaacgattaaagatgtcgcaggcgctgccggcgtctctgttgccacggtctcgcgtgtcctcaatgacaacggctacgtccatgaagatacacgaacgaaggtcatgcttgccatggagaagctgaattattatccgaatgaagttgcccgctctctttataaaagagaatccagactggtcgggcttttgcttccggatattacgaacccctttttcccgcagcttgcccgcggcgctgaagacgagctgcagcgggaaggataccggctgatcatcggcaacagcgatgaagaattggaaaaagaactcgactacctgcaaacatttaaacaaaatcaagttgccggtattttggcggccacccattaccccgaccttcccgaatacagcggcagcctttacccggtcgtatttctggaccggacaaaagaaggcgccccatccgtattcagtgacgggcgggcaggcggaaaacgggcggctgaggaaatgcttcgcggcaaaagcacaagcatcacgcttgtcaaaggcccaggccaccttccgaccgctcaggaacgttttaacggcgcacttgatgtgctgtataaagcgggcgcgcagttcaatgtcatctccgccgcttcattttctatcaaggatgccgccgttttagcagaaaaattgtttgcagcataccccgaaaccgacggagtcattgccagcaacgatattgcggcggctgccgtcctccatgaggcgctgcggctcggcaaaaaagttccggaggagattcagatcatcggatacgacgatattccgcagagcaggcttttgtttccgccgctttcaaccatccgccagcctgcatatgagatgggaaaacaagcggcaaacctgctgctgcaattgataaagaaagagccgccgaaagagacggccattcaactgcccgtgacttatataagaagacaaacgacgagaaaggatgatcaccatgagtgaaatttgtgttatcggaagctgttctatggatctggtcgtcacatccgaacggcgtccgaaagccggagaaaccgtactgggcacagactttcaaaccgtgcccgggggaaaaggcgcaaaccaggccgtagccgcttcccgtctgggcgcaaacgtatatatggtaggaaaagctggcagtgacagctacggaaaagcgattattgaaaacctgaaggcaaacggtgtcaatacggactatatggaaacggttacacataaaaaaagcggaacggctcatattgtgctcgcagaaggagacaacagcatcgtcgtcgtaaaaggcgcaaacgatgacatctcacccgattatgccaaaagtgcgctggaaaaacttcccggcattgatatcgtgctgatccagcaggagattcctgaagaaactgttgaagaagtgtgcagctactgccgcgcgcaccaaattccggttatcctgaatcccgcgccggcccgcccgctgaaacaatcgacgattgagaatgccgcatatcttacgccgaacgaacatgaagcatccattttatttcctgaccggacgaaagaagaagcgctcgccggctatcccggcaaactgttcattaccgaaggaaaacaaggcgtacgctactcagacggcaccgcggaacggcttgttcccggcttccctgcagaagcggtcgacacgacgggtgccggcgatacctttaatgcggcacttgccgtcgcgctcgcggaaggacgggacatcgagcaagcgctcctgttcgccaaccgcgccgcctccctgtccgtgcagcacttcggcgcccaaggcgggatgccggtcagaaaagaagttgaggagctgctgtcatgaaaaaacacggaatgttaaacagccacattgccaaagtattagccgatctcgggcatacagacctcatcgcgatcgccgatgcgggtctccccgtccctgacggcgtccctaaaattgatttgtccttaacggcgggcattcccgcctttcgggatgtgaccagcctggtagccggggagatggccgtcgaaaaggtgatggccgcctccgagatcaaagacgaaaatcctgagaatgcaagtttcatagaaagccatttctcagcgcagacgatcgagtacatgtcccactcggaattcaaacggctcacacagaaagcaaaagccgtcatccggacgggtgaaatgacaccatacgccaactgcatcctgcaggcgggtgtgattttctagaaagaagggatccagcatgcacatcggcatgacagacattcataaagcattcggcaaaaaccaagtgctatccggcgtctcatttgagcttctgccgggagaaatccacgctttaatgggagaaaacggagcgggcaaatcgacgttaatgaatctgctcaccgggctctaccggctcgacaagggaaacattacgataaacggaacaaatatgaatttctccaatccaaaggaagccgaaaagcacggaatcgcctttatccatcaggaactgaatatatggccggacatgacggtgcttgaaaatctttttatcggcaaagagctgacgacggcgttcggcgttttggaaacgaagaaaatgaaagcgctagcaaaatcacagcttgaaaaactgggagtctctcttcctcttgaccgggaagccggacaatgttccgtcggccagcagcaaatgattgagattgccaaagcgctgatgacaaacgccgaagtcattattatggacgaaccgaccgcggcgctgaccgaacgggaaatcagcaaactgtttgacgtgatgacggcgttaaagcgggacggcgtatccattgtctatatttctcaccgaatggaagagatattttcaatttgcgaccggatcaccattatgcgggacggcctcactgtcgatacggcgcatatgaaagatactcattttgatgaagtggtcaaaaaaatggtcgggcgggagctgaccgatcggtatccgacccgcacgccgtcactcggcgataaggtgctcgaagtgaaaaacgcctcaaaaaaaggaagattttcacagatcagtttccatgtgagcgccggagaaatcctcggcgtttccggcttaatgggtgccggacggacagaaatcatgagggcgctgttcggaattgaccggctcgattccggagaggtctggatttccggccgaaaaaccggcattcggggtccgtacgatgccatccgcaagggactcggcctgattacggagaaccgcaaagatgaagggctgctgctggatacgtccattcgtgaaaatatctcattgccgaacctgaccagcttctctccgaaaggcatcattgaccgaaaacgcgaggcggagttcgttgagctgctcatcaagcgtctgaccattaagactgcatctccggaaaccgccgcccggcatttatcaggaggaaatcagcaaaaagtcgtcatcgccaaatggatcggaatcggcccgaaagtcctcatccttgatgaaccgacaagaggcgtcgacgtaggcgcgaaaagggaaatctattcattaatgaatgaactgaccgatcgcggagtcgccatcatcatggtgtcttccgagctgccggaaattctcggcatgagtgacagaatcatcgtcgtccacgaagggcgcatcagcggagaaatcaatgcggcagatgcaacacaagaacacatcatgacacttgccacgggagggcagcagtatgaaaactgaaccaataacatcaactgaacaaaagcgattttccattcataccttcacgcaaaaactcggtccgtttctcggcttactgattcttgtgctgatcgtttccgttttaaacccgagttttcttgaacctctcaatattctcaatcttcttcggcaggttgcgattaacgctctgattgcattcggaatgacgtttgtcattttaacgggaggcattgatctctctgtcggagccatcctcgccttatcgagcgcagtggtcgcaggtatgatggtctcaggcatcgacccgatcttagccgtcatcatcggctgcgtgatcggcgccgtactcggcatgataaacggattattaatcacaaaaggaaaaatggcgccgttcatcgccactttggcgacaatgaccgtctttcgcggactgaccctcgtctatacggacggaaatccgattacggggctcggttcaaattacgcatttcaattattcgggcgcggttattttctcggcatccccgtacctgccattacgatgctgattgcatttgcggccctgtgggttcttctgcacaaaacaccgttcggccgccggacatacgccatcggcggcaatgagaaagcggcgctgatatcgggaatcaaagtgccccgcatcaagatcatgatctattctctgacaggtttattatcggcgctggcgggagcgattctgacatcacgcttaaattccgcacagccgacggccggagaatcatacgagctggacgccatcgcagcggtcgttctcggcggaacgagcctgtccggcggtcgagggcgcatcatcggtacgctgatcggggttttgattatcggtacgctgaacaacggcttgaaccttctcggcgtatcatcgttttatcagctcgtcgtcaaaggaatcgtcattttaatcgcggtgctgctggaccgcaaaaaatcggcatagtaggaggaccattatgaagaaagccatcatcacgatcgcggcattatcactgtttttgctgtccgcctgttcacttgaaccgccgcaatgggcaaaaccgtcaaacacaaaacataaaaaagaattcactatcgggctctccgtctccacattaaacaatccgttcttcgtttcattaaaagaaggcgttgtaaaggaagccaaaaaacggggcatgaaggtcattattgtcgatgcccaaaatgattcatctaaacagtcaaatgacgtagaagatttgatccagcagggagtcgatgcgctgctgatcaatccgaccgattcatcagcgatttcaacagcagtcgaatcggcaaattccctcggcattcccgtcattgcgctggatcgttcagccgaacacggcaaagtcgaaacgcttgtcgcctctgacaatgtcaaaggaggagaaatggcggctgactacctcgccgatcagctcggaaaaggcgccaaagtggctgaattgcaaggggtgccgggcgcatccgcgacacgggaacgcggaacgggctttcatcatattgccgacaaaaagctggatgtcgtaacaaagcaagcggcagattttgaccgcacaaaaggattgaccgtcatggaaaacctgctgcagggacacccggatatcaaagccgtgttcgcccataatgatgaaatggcactcggggcgctcgaagcgattaacagctcgggcaaacacattttggtcgtcggtttcgacggaaataaagatgcgatttcttccattaaaagcgggaagctgacagccacggtcgcccagcagccggagctgatcggaaaactggcggccgaagcggcggagcaggtgctcaaaggaaaaaaagtcaaaaaaaccatttccgctccattgaaacttcaaacgcaaaaataaccggctgatgtttagacttccggtaaaacgtgaaaggatgaagtaaaaggagagatacagatgaagaaaacagccaaagcggcatccattctgacccttgcagcgggaatatcagcggcttcagctgccggaataacgcctcttcccgagacacacgcgcaagaagcggtcaaaattgacgatctgtacagctacccgcttgactcttatctcgtttccgcggaagcattgaacgtgagaacaaaagcatcagcagccagtccgagagctgatacccttcatttaggcgacagcttaaagatcgtttcattccagaacgctgactgggcaaaagtacattataaaaacggaaaaacaggatttgtatctactcattatattgttaaagaagcaacaaccgtaaaaacgacggcaaaaacaaaagtatatacagacaaacaagcggtcacagcttcccttgccaaaaacacgagcgtttctttcctcggatggaaaaagacagccggcggcggcattgatttcggctgggcgcttgtcgattacgggggcgcaacgggatatatcagcacaaaagatctgcaaaaactgacataatatcaaaacggatttcgcaaattcagcgcgaaatccgttttttctttcttgagcagtcagaaacgtctaaggttcgaaatatttctcaggaaatattgtcggatgaagatgaatgcatacgactctaaaatggcttctttatgtaatccgccaggcgtttggcgttgtcacggatagccgcagcatcggcgctgctaaccccgtacatcgcgaaagccggcaaataggtcattcccgtaaaattagccattgcctgaaacggccttaagagctcgctcagtgaaaaatggttggacccgcctgcctgatatgcatcctctccggcacctacagaaacagccagcagcaattctttgccgtgcagcgcctttcctttggaaccgtaagcccagccatacgccagcacatgatccatccatgtttttaaaagcggaggcgcactgtaccagtacagcgggaattgaaatacgatccggtcatactgttcacacagctgccgttccttttccccatctattttcccgtccggatattctttataaagctcacgaaccgtgatgtcatcatgattttttaattcttctgtccacgccttattgaccgctgagttgtccatgtcaggatgaaccgctaataccaatactttcacagctaccacacctttcccttttgactgtattttacctaatctttgccggttcagccaaataaaaagaaagccccgagaaaaatgaggctttcttttttattttattccgggcttccttcggttgtttcaatatccttcgcaaaattcggattatctaaatttgcgttgaaaaagtccgccgtattcggaagcttgaggttcatattcattttttgagaaatggtcactttacaatctttaatgacatagtcaaacacgtgtcccccggaattgcgtccttcatcaatgaagtgcaggtgatatccggaaacagcgatgccgtttgcgtaacccggcgtccagaagccggcgattgtaccctgaatgtcgtcaaagttgaacacaggctgtgttttcaccgcttcaatcatcggaacgtacggtttctcctggcgttctaccgttcttgtctgcacctttttaaatacgccgtctaaacggatcgcataaaataagtttttactaggcagaaggctggcgatttcctgctcgaattcttcacgggtcatttcgccgtcgatcgtatgcgtcatgtccggcgtgaaaaatgtgaatgagcagaatggtgacaggtctccgcctttaacaggcgtagccgttccgtcgccgcgcagacggtaaaattcgccgtcaaatccgattaattcgccgtccagtttattgaacgtgccgatcccgaaatcaccgaacttcggaatgtcagccatatcaaaatctccgtcatacactccgtccagcagagatgtcatggtggatacttgatagatttgatcctcaggtgagcctttttctccgcggctcatcatatggatgtcgcttgcgtttttcatattcccttcactccttttaaattgggctgttttagaaaacaggtcatggtgcgcagagtgctagagagcttttgctttcattttttctttgaattgcttcggaagcatgtcgcttgataaatggacattgtcactgtaatcgacaggaatgtcaatgatgacagggccttctgtgttcaagcctttttgcagcacgtctgccagctgttccggtgactcaacgcgcaagccggtggcgccgaagctttctgcatattttacgatgtcaatgtttccgaaatctacgcatgatgtacggttatattttttcatttgctggaatgcgaccatatcatatgtgctgtcattccatacaaggtgaacgatcggcgcttttaagcggactgccgtttccaattccattgcagagaacaggaatcctccgtctcctgaaacggatacgactttttcacccggattcaccaatgtggcggcaatcgcccaaggaagcgctacgcccaatgtctgcatgccgttgctgatcaacagtttcagcggctcataagcgcggaagtagcgggacatccagatcgcgtgagaaccgatatcgcaagtgacggttacgtcgtcatcaattgcattgcgcagttcttggacgatttgcagaggatgcactctgtcggatttatgatcgcttggcgccttctcgctgtctgtgagcatctgttttaactcgctcagcacttctttttcacggctgcccatatcaaatgtcacagcgtcgtgttcaatttgtttaaccgtagcggggatatcgcctaataattctaattccggctgataggcatgatcgatatcggcctggatttcgtcaagatggataatagcacggtcaccgtttacgttccagaacttcggatcgtattcaatcggatcataaccgatcgttaatacgacatccgcctgttcaagcagaagatcgcccggctggttgcggaacagtccgatccggccgaaatattggtcttccagctctctggacaatgtgccggccccttggtacgtttctacgaaaggcagttttgttttggcaagcagtttgcggatttgttttaccgcttccggtcttccgcctttcataccgactaacagaacgggaagtttcgccgtctggattttcgcgatagccgcgctgaccgcctcttccggtgcagggccttgtttcggcgccggcacgctgcgtacgtttttcacatttgtgatttcattcacaacatcctgcggaaagctcacaaaagccgcgcctgcctgacctgctgacgctgccctgaaggcgtttgttaccgcttctggtatattccctgtttcctgtacttctacactgtattttgtaatcggctgaaatagcgccgcattgtccaatgattggtgtgtccgttttaaccggtctgcgcgaattacgttacccgccagcgccactaccggatcaccttctgtattagccgttaacaagccggtcgccaagttggatgcccccgggcctgaagtaacgagacaaacgcctggttttccagtcagtcttccgacagccgcagccataaatgcagcgttctgttcgtgacggcataaaaccagttcaggtcctttatcttttaacgcatcaaatactgcatcaatttttgcacccggaatgccaaaaacatgtgtgacaccttgctccactaagcaatcaacaacaagctccgccccccgatttttttcagaggtttttagttcatttgttgcttttgccaacaccctcactccttattatgcatattaaatataaaattttaagtaatttgtgatattattcactatacactctttggaaattgacctccaatatcaattcgccgtatgattaatatgtttcacgaataattaacaaagagaaaggaatggataaggatggagcttcgccatcttcaatactttattgccgttgccgaagaacttcatttcggcaaagctgcgcttcggttaaatatgacacagccgcctctcagccagcagatcaaacagcttgagaaggaagtcggcgtgaccttattaaagcgcacgaaacgggttgtagagctttcagctgccggagaaagttttttaaaacacagcagaaacgcgatcgaagaaatagacaaagcgattgaaatggcgcagagaacggcgcggggagagctcggccgccttgtcgtcggttttgtcggctcggccacatatgaatttctgccgccgatcattcgggaattccgcgaaaaattcccctccgtcaagcttgatctgcgtgaaatttcttctttcagacagcaggaagaacttctgaaggggaacattgatatcggcatccttcatccgcctttacaacattccgcgttacatatggaaaaggtgcagagcagcccgtgcattctggctttgccgaagcagcacccgcttaccgctaaacagacaatcgacattcaggatttaaaaaatgaaccgattatcacactgtcgaaagaaacatggccgactttatacctggagtttgtaaactactgcgagcaggcgggcttcaaaccgaaaatcgttcaggaagcgacggagtatcaaatggtgatcggattggttagtgccggtatcggtgtaaccttcgtgccttcttctgctaaaaagctgtttaatctcgaagtcgcctaccgcggcattaatcaggcgcagctcactgccgaatgggtcattgcctaccgcaaggataatcaaaatccgatcctgaaacattttctggatattatgaataagcgccaggctttattgcaggcggataaggaaaatgcataaaaaagagggccgccgaaagcagcctcttttttttgtgcttttatggatttttactaaattggtagaaacgctcagtacaccttacgacctgtacccgtatacatacagtacaactgatcaggagggataaaaataacggggcggcaatgacccatcgaaaaggaggcagaacacattacacatattaccgtcattttgaccctgatttctttctttgtgaccattatttttatattttggagacccgggggattaaatgaagccgttccggcgtcgctgggcgccattctcgttttgttatgcggaaccgtttcctttcatgatttgggggatatagggtcaaaagtcaccggagcatcaataaccattatctccacaatgataatggcgatcgcgctggaaagcttcggtttttttaactgggcggcggccaaactgcttcaccgcgccaagggatcaggcatccggcttttttggctgaccaacctgctctgtttttcaatgacgctctttctgaataatgacggcagcgtcttaatcaccactcctattttactattggtcttacaatatctcggacttaaaagacatcagaaaacaccgtatttaataagcggcgtattaattgcgacggcggcaagcaccccgatcggcgtcagtaatatcgtcaatttaatttctctcaaaatgataggcatggacctttatttgtacaccaatatgatgtttatccccggcacgctgggactggtgtttatggcctttctgctgtttgccgttttctaccgccgtttgccgaaacagctccccgatattccggttcattttgaatcgctggaacacaaacgatatcatccgcttcagcctccgccagacttgtcccaaaaaaacagccgtacgaacatcatgttttgtgttttggtatttgtattgtttgtccggatcagtctgtttgcagcttcttacaacggcatatccgtttcgctcgtggctgtcatcagttcagtcatcctgctttgctggagatggttttatttaaaaatcggaccggcggacttattaaggaaagcgccttggcatatctttatttttgccttcacgatgtacattatcatttacggactgcataatatcggactgacggcattgcttgttcagtctattgagccttatgtctcacaaagcattgcccacgctgcatctattatgggcattgctacatccgtcctctctaatttgttcaataaccatcccgccttaatgatcagcactttgacattaactgaaatgtccatcgacccattaaccgtaaaaatcatttatctggctaatattatcggcagtgatatcggatcattgcttctgccgatcgggacattagccacactgatctggatgcatatcatcagacagcacggcgaaaaagtttcttggtcagaatatatcaaaacgaccattgtcgttgtccctctcaccgtcgtgtttaccattaccgttttatatgtttggatcagctggatttacctttagctatgaaaaaaaactgcctgctgtataagagaggcagttttatcatttatggcaggtgcatggtttttaaatgattcaatttccaaaagacagtatccccgtctgcattggtcaattcaagaatattatctgagacgtcctgtaacagccccactttattcggtatatctcctaaatccagaataatcagcttcccgacatatctttttaattgctcctcaaaattccggacaaggggcacattagcgggaacaaccggcagctctgaactgtttaatgtatacggcgtctgctcatcggaatagggtgtcagccatttcaaatgatgcatcgagatgaaaagagtcttataaaccggagagaagaaaacaaaataatcatttaaaacacttgtcacatacccatgaatggaacggtctcccgtaacgaaaatttctgtaaatctgccttttatatgctggagggtattccggtaagaaaaggaatgttcctgtttttcgggatgcggacttttttttcttgcgtacggttctttattctcttcgtccgggagcgtcaatgtcatcctctgaagatgcagcagcggaatataaagaaacgtccggccgtcatgaatcacaatgatatcctgaccgatatccaaaagagttcctgaaaatgtcgtattccccgatatctcaatatcgacttgtttatcaagaaatctgcttaatccagccatttcattcccccctctcccgcgtttacggacaatctttccaatcatttacggccgtgtttccacctataatctattgtccttaatacagtggcgtagctataagagttctcttcctcccgttttgaggatcgaacggatcttgacgatcttttcgactttttagaggaagtacgctgctcttcgcgagattcttcttcatgtgacttttcttcttcggcgctctctttcccgcctttattctcgtcgtctttattctcctcttttttggctgctccttttgccccttcgctgatgctcttgatatgaaaaggatagatccgcagcacttctttatctttcacaagagtgtagtggccgtcggaattatccacaagtataccttcaacggcttcaggacctccgcggttgatggatacccatttgtggatcaggcgtttaaatatgccgtgaaaatcatcagccatttcaaattccgggcgctcctcctcctggccgtcctcttcttgttccgcgctgatgcttttgacatgatcggcgttaaaatatacgattccgtcatcttctgtttccagcacgagaaaatcatcccctgtttcgtgaagctttcctcttttcgattccggacctccctgattcaattgcaccgtgcgattggtcatccggctgatcagatcttgaaaatcatcagctttttcacattctgccgcttcggccggcgatacggtttcactcgtattttccgtcacacttttcacgtgtttccattgataataaacgattttattatcaacttgaagagcgatataatccgattgaatgtctgctaatctccctgtcttggactccgggcctccccggtagacagtaattacttttccttccatcgcatgcaaaaagttgtcatcagaccgatgccgcttcgtattgcgtttcatctattgtcctcctagtcatttttctcataatgtaaaaagcataatgcatatatacgtatcacgattattttcgggaactgattcaccagcctatttgtaaaaaatctttcttcatttccaaatcagatattccaccgctctaactcactgctgatgaaggcggaccgctccttaatgtattcgcaaatcacatcaggctcccggtcaaagcaatcaatctcctctttcttataaggatcctttgcgacatgcggcctgatctgctcatacagtgacatgaccttcggcttcatatgttcaatggtaaaccgggtctgaagcgtttcttccaaaagctgtttgtacgctttgcggaaatacggttcatccagaagccttgcagtcaaggtattaaacccttgtattctgacataatcggcctccatccgatcaccgtgaatgtctcttccccacgtcgcatcgtaatcccacggaatgacttcaaaaagtcccgtttcatgattccggtacaaagcgtaattatgaacaaatccatcgtagtttgaggtaaacacgatgcccgcaagccaccgcaaatacttatcggcgtccaagtgtttgacgatctcccccttgaactctgacttcggaacggtattaattttatagatcatgtcctgcaagtataaatcgtcttctttcgttcccgttttcttttcataaccaagttcgagcgatgttttcgtatcccgctccagatcactgacaagggagaaattggcgtcgtcatcaaccgcgtaaaaaacagccccgtccgccaaattccgtttcgccagaaaatattcatccactgactccagctcaagatacaccccctcatgtctgccattgatttgcagggttacgaaattcgcctttggtgacagcgtcccaagctccgcgaagaaatcgagagacagcttattccgcatcatcgacggatctttgtattcagcgtttaaatgtatctctttcgccctgcgaaatgttttcggcgaataaaaagcgatgtgatacgattttttcttaaaatctcttatatgagagccgcggtacgccagatcaatgtcaagccgtttttgattcactctcagcaccgcgggcaccggatcatcatcccaaatgtcttttttcagctccattaagtctttcgggtgaataaacagctggtatagaggcaatgttgattggtctttcatcagtaaccctccctgtattaatttaggctgtgctatttatataaaactcagcgaatcacacatacacttttttcattcatgcgtactatgtggtagtaaggatcgcatccttaaaacatatatcatgaggaggtttcaaaatgggccactattcccattctgatatcgaagaagcagtaaagtccgcaagcaccgagggattggaagattatttgtaccaagaaccaaaaagcagtaagaagagaaaatctcgcagccataaaaaatcccgttctcacaaaaaatctcgcagtcataaaaaatcgtgccgctctcacaaaaaatctcgcagccataaaaaatcgtgccgctctcacaaaaaatctcgcagccataaaaaatcccgttctcacaaaaaatctcgcagtcataaaaaatcccgttctcacaaaaaatctcgcagccataaaaaatcgcgccgctctcacaaaaaatctcgcagtcataaaaaatcccgttctcacaaaaaatctcgcagccacaaaaaatcatgccgccgcaagaaaaaacgcacgcagaaaaaaccttaccgtcctcataaaaaagacccttgcaaaaaagacgattactgcagcaaaacagagtactggaaagacgggaacatctgggttgtaaagaaaaactacaagtaacgccatttgtaaataggctgccggctaaacggaagcctttttcctcaatcagatatatgccacgtgataagatatgcagccggttttcttttgttgtgtttccgaattttctttctgtataatcaggtcatacgataaagaaaggcggccgaaatcatgcatatcttacgagcagacgaactgaacgcaaaagacacctacaaattgctttcgggcacagtcgttccccggccgatcgcatttgtcacgacgcggtcatccatcaacggcgccgtaaacgcggcgcccttcagtttctataacgttgtctccgcagaaccgccgcttctggccatctctgtcagccgcgcggacggacggcagaaagacaccgcgagaaacgcaatcgctcatcgggaattcgtggtgcacgtcagtgatgagtccattattgaagacattaacaaaacggcggcaaggcttgatcctgatgtcagtgaacttggcatgacagacctttctgtgacagacagcgcctgcatcagcgttcccggtataaaagaagcaaaagtcaggtttgaatgtatactcgaacgccatcttccgtttcaaaatgacagcggagaaacgacgacagacctcatcatcggcagagtcgtttgttttcatttgaatgaccaagtatatgacgccgataaaggctacatacggacagatgagctgaagcctgcggcaaggctcgcggggaatgaatacgtcagactcgggaagacatatacgcttgtccgcccgacctgaagcaggaaccattataatagaagaaactagtcaaaaagacccctttcgaaaggggtcttttttgagtcttttaccattaaactcagcctaatgtcttatagaatgctgaaacttacaaggccctcacccatatgaaacgagtgacatttttaggaggagacgatggatttcattcagttactgattttttcagccgtatttattttgctcagccttatgtttcaagtatttgccgtcaaagttcttcattttccaaaggctgttaaaaagcagaagccgataaacggcacacatcgattaatcgaaatcacactgcttattacgggcatcgcagcggtgactttgttcaatgaaatgtacgtatttgcgggagttgttttcatgctattttgctgcagcggcttaatggaatggcggcaccggcgggaggaaaagcaatatgtgtacgattcgttttacgcaggtctttctgccgctcttggcgtgcttatttttttcatcagttagcgtatcatgctctatactcctgcggccgctccgtcgccgcgcgggtcggccccgccttggagaaagccttcttcatcaatgacgatcgctgccgcatggcccataagcccgtcaaaatcaccaacggtctcgacgcggtggccgctctgccttaaggcttctctcgtttcagggctgattctgctttcaaccctcagcccttcatactcctctccccatgtccgcccccagacccagcgcggctcattgatcgcctgctgcgggtccattttgtaatcaatgatgcgcgtaatcatcgctgtctgagtttgcggctggccttctcctccctgggttccgtacaggatgtgcggctttccttctttacaggccatcgccggcatgagggtgtggaacgtccgcttgccgggttcaagtgtattgacatgggattcatccagcgaaaaaaatgacccgcggttttgcagcagaatgcccgtctcccccgccgtaacggctgacccgaattcaaaataaaggctctgtataaaggaaacggcatttccttccgcatctctgacggcggcataagcagtgtcgcttccgaccggacggcttagcgccggcgcagccgtgtcaccgatttcttccgccagctgctttgcataccgtttatcaagcagccgatccagcggaatatgagaaaatgccggatcagtcagcacttcattccggtgctgaaaactcttcttcagcgcctcgatcagcagatgataatagtcaaaggagccgtgttcaatctgagaaaaatcatagttttccaatatattgagcgtcattaagcctgtaaagccctgtgaattcggcggagcctgatagatgcggtatccgcggtaatcagaggataccgggttcgtccactcgccgcggtgggctttaaagtcatcaagtgtcagacggctgccgttgttttgcagaaaggatgtgatgctttgagcgagatctccttcataaaaagcgcttctgcctttctcggcaagctgttccaagctggccgccagattcttctggacaaaccgttcaccgggcatgggcgcttttttgtttctcgtaaaaatggccgaggtgtaaggcatcgaggctaaaagagcgagattgcgttctgtgtgggcgcactggtcggcggacaccgggaatccgtttgccgcataatcaagagcaggcttcagcacctcagcgagcgaaagacgcccgtacgccgaaagcacggcatcccagctgtccgccattcccggaacggtaatggcgctttctggcccgcgcagagggatcgcttctctgccccgatacaagtctctcgtcacatgcttccctgaacggccgctcccgttataagctttgattcgtcccgtttctttatggtaagtgagccaaaatgaatccccgccaagacccgtcatatgcggatacacgactgccaggcaggcgctgaccgccactgccgcgtcaaacgcgtttcctcccttttccagaatgccggcccccgcctgagaagcaagataatgcggactgacgaccatttgtttcgttccgatggttgaagtattcatggcaagcccctttacaaattttcctaagtataaaaagcggcttcaccggtatccaccttcctgaaagaaaagctcacacactatttactttccgataagaaataatcctaagttattacgtaacgaaaacaataaaaaaatttccccttcataccgtaacatttcatgatacaataatatccaccaaatgaaggaaggtgaagccggttggaacatgagtacagcattccgaatcttgtccttgatgaaacggataaacagattctctcgattttgcacgaggaagggaggatttcctatacagacttaggaaagcgggttaacctgtcgcgagtggcggttcagcaccgcattcagcatttactggatgccggtgtgattgaaaaattcaccgctgtcatcaacccggcgaaaatcggccgtcatgtgtccgtgttttttaacgtggaggtggagccgcagtatttggaggaaaccgcattaaagcttgaaaaggagccggcggtgacaagcctttatcatatgaccggaccgagcaagctgcatatgcacggcattttcgcaaatgatcaggagatggaagagtttttgacaaaacggctctatacgcaaaaaggcgtcgtcagcgtcgactgccaaatgctgattaaacggtataaaagcagaacgggcatgaagctgtaaggaggacatagccatgaaacatccctattgggacattacggcggcgatggtccgaacgggcattctcggattcggaggcggcccgtcggtgatcccgctcatccgccatgaagccgtcaataaatacaaatggatagatgatgatgaattcggagaaatattagcgatcgctaatgcgcttcccggaccgattgccacaaaaatggctgcgtatctgggcttcaagctgaaaggcacgttaggcgcaatcgcggcaaccctcgcacatattctgcctacatgtctcgctatggcgggcttgtttgcggctgtcaatgtcttaagccgctcagcaatcgttgccggcatgattggcgccgtaacaccggtgatcgccgtcatgctcggcatcatggcgtacgagtttggccaaaaagcgcttaaaggtttcggctgggtcacgggcatcctgttttttatcatcgcttttatcggcctgcaaacgttacagatcaatcccggctttgtcattatcattttcttggcatacggcgcgtttcattttaaattaaaggacaaaatcacaaagaaacgttcaaaagataaaggaatgccggcctcatgatcttgatttatgtatttatggcgtttcttgtcgcaaacgtactcggatatggaggcggaccggcgtcgattccgctgatgtttgaagaagtcgtcaacagatacagctggctctcaaacgatcaattctcaaatatgctcgcacttgcgaacgcattgccgggcccgatcgcaaccaaaatcgcggcgtatgtcggctacagcgcaggcggatggcccggattcctgattgcgctgatcgccaccgtcgtaccgtcggcgctcgcattgatcatcctcttgcgcgtcattcagcgcttccgccaatcccccgtcatcaaaggtatgacgctgtccgtccagcctgtcatcgccgtcatgatgctcattcttacctggcaaatcggcgcagacggcatcaaagcgatcggctgggttcaagcgatagtgattgcggggatttccctccttgtcttgacaaaattcaagatgcatccggcctttctgattatcgcggcgtttttgtatggagggcttgtgattcctcatttataaagaaaagcacctggacaggtgcttttttattttggcccggaaataccatttgatatgacaactgtttcttcgcctgcatcactcttgatgatttgcttgacttgcagcgttgcgcctgccattctcacagattgctgaacctgaggtgaattggtttcagcctgtatccaaacagaagtcggcgctttccaagctagaaagagtgcaagaatcaacataccagagataaccagcagcagcttcatatcgcatcacttcttttcaataaacggctcgcagcggacagcgcctgttgatcatgaagaatatcacccggacgattgccttctcccagcacatagcctttaaaggacatccccataaaatgaaaaatatgttcaaattgctgaatcagcggcagcccttttagtttagggttgtctccgcccactgctgttacatatgcctgcttcgctgacatttgctgtttaaaatcaggaaacctcggatctctcagcgtctgtgaccagcgatcaataaacagctttaatgtccctgacatgccaaaccaataaattggggtggcgaatacaagaatatcacacggtaatatcagctcaatgatagaatcgtagtcatcttgaacaggacgaaagccgccttgggcgtgacgcagatcttcaattggccggatccgatatttccgcaaatgaatgtgctccgcatcgaatccttgaacagccttctccgcaagaatatccgtatttccgccaggcctcgttccgccatgaataaccgcaatgttcatgatgcatctgctcctttgtttacgaatgattttcttcatcatataatggattcatcaatcaatacagatgattatttcgattattccaatcgataaaaccgatttagaaagggcgagatcaaatggaattgaagcagctgatcacctttattaccgcagcagaacacgtaaacttcaccctaaccgccaagatgcttaactatgcacaatcaagcgttacctctcagatcaaatcactggaagaagaaatcgggactcctttatttgaacggctcggcaagcggcttttcctgacagaagccggcaaaacgttcaaatcctatgcggagaagatcattgcgttaacagaagaagcaaaaatggccgcaaatcaagcaagagaaacaaccggaaccttgaaaatcggcgcgacggaaagccagtgcacataccgccttccgcctatcataaaagaattcaaacaggcttttcctcaagtaaagcttatattcaaaccgtatatttccaacgaacaagcgaaagaacagctcttgcagggccagcttgatatcactttcattttggatgtgaatcggtcggaagacgcactgcacgttgaatctctgattcaggatgaaatcaaaatggtagccgccaatgaccatccttttccagcagactcaccagcagcattgaaggatcttcaaaatgaaacccttctgctgacagaggacggctgttcatatcgcacgctctttgagaacactttacatgacgccggagtctaccctaataaattagaattcgtcagcatagaagccatcaaacaatgcgtgatggccggactcggaatcggactattgcctgaaatgacagtaaaagacgatattgccgaaggacggatgaaagaactcaactggcagaatgaatgccccgtttttactcaactagcatggcataaggacaagtggatgtctgcgccattaaaggcatttatcgatttgacgcgaaaaacattcaaataaaaacctgctgcaaggacgacaaggttttttaaagcagacaccaggcatacaaaaaaaacacttggtggcttagagctccaagtgtttcatgtgatttttccgataaaacgttcgcaaaacatgcgtttcaaggtcagccagacggacagggatcggcagcctgctttctcgattgatcattttcattgtgatctgatagctgctttctaaatcaatgttatgtccgcaagacaagaagataggcttcacgtcccgccgtgtccgaagcgcccagccatatacctcgccgtcaatgagaatatcggtgtaggcgcctacttcattttcaggcatctcaaaatcgcagcctttgattttgagataggttttcgcaatcccaatcgtcggcttccccagaaaaaaagccgcatgggtggcaacgcccatatgattgtaatgcagatacccgttgccatcaaacaaaaacacatccggctccgtctccagctttttggccgcttcgatgatcagcggcagctcgcgaaacgcaagaaaaccggacacatacggcacgctgattttccccatgctgtgcactttttcaatcacttctgttgtatcagcgtcaatcacgatgatactgcacaccccgtacggttccccgtcctgctcccaataagcgaggtcgacgcctgcgctggtgttgacggagtctggatggatgacgggggataggttgattttatgtataagagattgttgagttcgaataaaatccgattcatctttttgttcaaaatcgtgaatttgatgtattttcatttcacttgttttcctctcttaaaatagtcttcgcgctcaatcgtcctgtgtttcgatctagcgaagactccatatgcttcattgaaaaaagcagatagtataatctgctttttattaaaattcatttttcatttctttcataaaaataagatccaattgtttaagtaattctttaagttcagtacacataatatcttctaaaggattttcccaatctttgttttttatcagttcaatgccataactgccggttggatccccttctgggtaccaccctacaagcagcaaatttttagttttatgagaaactgcaggagatcttgattaaagtcaaataaccaagcatcatcattttcctctagagttttagggtcagtatcttttaatggaatataatcaacagtccaccccgctggtatcttaagccttaagaaattgggaacatgttggcttaggtgctgcaaaccctctaaaaccccacttcccacagtccagatttgatattccaactcttccaataattgttctatttcattaaaagagtcttctttataaatcttatctgtttttaagcccgctactatgacatggtattaatcattttcaaatattaccttaataacagcattacgtttttcattttgtagttttagtaattcatatttttcttgcattcttttttctgaacttaaattgttcagtactacagaccagccattacagatttttaatggcagcaattgagaaatatggtctctatccataactgcttctccttgtactccacattgttaaattattataaaaaaacttgccgataacaacaaggcaagctcttaactatagcaattctaatacatcagtaaacaaggcatctcctaatgttaatctcctgttgaaaggctgtatatgtggcaattcactccactcatacacagtatcgtagtaatcatacaaataactgagttcgataaaccctttctcttgcattattttattaatatagttcgttccctgaatgaattctaaagattcagcggttcctacaatgtcataagcgccatctattaaatcgtgtcttagggaataactataatctaatacataaacaggaaccaatttagatactttcatattgatttgctgttctaaatgaaaaccattttccccagaaagatcttgcaaatggatatcaatttctcctgaaggattgtttaaatctctaacttcaatttttttcaaaccttttatttgattaaattcatcaggtacttttattttctctgcgcatttgctcttgtaccattcgtctaattccctattcacaaatagacgatgaagcaattcaccgatttcagggtattcattaataaatctgattccatgttccatagttttaaccatcccatcttcttgaaggctcgccttttttcgtctgcttaccagttacaggatcaaactctcctaaatgctctgttcttctgcggttccacttttctaatttaccatgctgggaatcccattgccaattaaacccatctctatctgaccaagattttctttttaatctttcttttatttgtatcatacctctttcttccatccagttagttggttcttttaaacgatatccatttgaattgtctccaactatcttctctttatcagctagcgcagcattgtattcttcagtccgtttctttttactgtagttagtaccattatgagcaacataatcattttgagtcatcccctcaggtttttccaaccattttggtttttttgactggctactcgccatcttcacaatcccaagttctttaacagccgtcttttccacatcgacacggactgttgggaatccgtacgtaaagccgttcgctgttactgggcgttctgcgtacacgcggacgtttgtcgggactttgaattgtttaactttttctagtgtcttgttagctttttgaacttttgaatgggttgcaagcggtatgcctttgtttacatgcttcgccaatgcaccggctccaaccaaactcagcgcagcttccagcgccccttgcttccgtttttcctcagacactttgtttccgaacatatcccgtcctgtgacggcttctgtgaatccgtttgaggcgacgaggccgtatgcgcccatttctgtcattttgagaatgtctaaggattttccggttttataggcatctaaagcatgttctgcggcaatgacggtttttccggttttgtaaatggcttttccgcctttgaaagcgcggcccgcccagccgacgaccggtatgaatccggcggcggccatcgctcctgctgtgacgcgttctgcggtggagagtttttcgccggtcaccggatcaacaccttcggctgctcttttataatcataatagccggtgacttcgccggtaaagttgcagatgccgtcccatgttttttcgtaccatggtttattggcttcttcttcagccttttcctgaagccgtcttgcttcggcctgctgggcttttgcgtcaatatagtccgtgccctgtttttctgtcgccatgacgcttttgtagatttcattgctgtggaaggcttttttgtcatagtacataggggaggcgcttttcccgttgctggtggcctgcatgagaagggaatatttgctgagcactgcgttgtccagagattctaagttttgatattcagcggtcagggattcatcaagcgtatcgactgccgtgatcgtgtcgcgtctggttttctgggcatcacccattttatctgcgtaatcatccagcgtatatgtatcgagatgaataatatcactgatgccagacaaaatcgaatcgatttctgctttatgagcggagacaatctctgaagctctcaaatccgcattgggcagctcatgctctaaaaatgaagtctccgcatatgaatcactgagctcttgatctttaatgtcacctgaaatgccatttaaaaacgcaatttgagcagagacaagcgtcagccagctgtcggcgatttccgcttgtccctgaaagaaatcctttatattgtctgcgcctttccctttcaaagcatcacccagatcggccacgccttgaaaggcttgtttgagcgcacgcagctgttcttcaagggcttcgtattgtttctttctcttatctgcttcgtccgttaacgattgtgattcaaacactttgctcatcggcaagtcctttctttcgttattttacagcgatcgcctcgtcctgttccttcaaagaatctacgttgtctttaacgtccgctatgttcttatgaacggcctgcttgtattcgctgatcatcgatacaagctttgcctcgcgggattggtatttggaggtatagtcgagcttgttttttccgtttgtaccggcgttcccgatagaaacggcctccaaagcgctgctgacggattcaagctgcttcatgacggctccgtatttgagttttatttctgccattaaaaccaactccagctttttttgattgattgtattttttctccgaccgtgtcaagggcttcttctcccagcgtcagcaggtgctctgcctctctcgcgatgcttctggcggcaaggagccctcctttttcaatttcaagctgtgtcatctttaagccgattctgtaaatataaccgtcgtatttgtctgtgacgattctgtatgcttctgtatgggcctgatcgcgccggtcatcaaattcttcagcaaaagtgccggtccaatgatgatccaggtgcggcctgaggatgtccctgatttcagacacgccctcttcctgcagagattctatctctcttttcgcttcttttaatttatcaatttggtgttcgatctcgcccagtttatggctgatggtgctgttaatatggcttaatgtgcttgaatggctcatctgttttcacctcgtcttacgcaaaaagtcgtacaaaaagcacagacttttccatactatatttccatatattatattttaaaatagacagaaagcagcttaaataggttaaatgacttattttcagcagccgagatgctcatcattaacgccaaaagactcacacaaacggcatatccattcattgatctcctctatgtatccatgataaattccctaaaaaaaagagacagtgaataaccgtctcctttgccttgtatcatgattctaataatgtcgttaactgcagtcccagttgtacaaaacgtttgagaaatcttttttcttcaaatcttccggtctgataaagaaattggcgattcccacatctccccacatcgaatcaatgtcatcatctgaatcaatttgcaagagcagaatcgtatggttttgatgggaataagaccgcggatcttcctgggtgaaggacgcatagccgccgattttatggccgaatgcgttcaccgtatattcgtcatacacctcatcgtcaaactgctcgaaatagtcgaaggcatccatcccggcatattgcctgaattgaaaatcagacgggagcgcccattcagcagacagctcaggggtgatcagcgcttcggattgaatcggaaaatcgtactcctcttcaacctgaacgaaagaaaaatcatccatgagctcctcttcccgatctgtcacgtgctcaaaatatttgacgcagaaacccgtttgcgcgcacccgtcgtcaaaattcaaaccgtatacgtcatcactgaccgatatgtaaaactgaagaatgccggtgtccggaaaatcaggtagtccgggcatatccgcaaaattgatttgggcgagaagcttcatcggcctgccgctttcatcttcagggtatggttcatgtttcggaaaataggggtctccggcaattttattgtcatacagtcccgtttcagcttttttgacgtgcagtttgataaagggccgtgctgacgtttccagcagaccgcgggatgattccatttgcttcggcaatttccatgtgttttccacgattaatatctccttcgtctctaatgattgtatgataaaaggccggcgcggaccgccggcctttcaagtgacagaatcagtctgaggcacgacggctcttcttccgattgagatatattccacgcccgcctgttccgcttcctcaagcgagtggcagtttctcccgtcgaaaataaccggggtttccatcagctctttgtacgcttcaagcgggaagtgtttaatttgttcccaatctgtcagaatcaggacggcatccgctcccctgacggcttcttctatggactcccgataggaaaccgcagacggaagcagcccggaagcccggaatgacgcgatcggatcgtacgctgtcatccgggcgtcaagagccgccagacgatccgcaatgacaatggacggggcatcccgcatatcatctgtattcggcttaaaagacagccctaataacgcgatggttttccccgtcacaccgcccagcctgttcagcactttatcaaccagcatggactgctggttattgttgactttaatgacggacttcagcaattcaaaatcatgctccacatgtcccgcgatctgcacgagggcgtttgtatccttcggaaaacaggaaccgccgtaaccgatgccggctcttaagaattgattgccgatccgtttatccaatcccattccgtgtgcgactgattccacatccgcaccgactttttcacatatatgagaaatttcattaataaaactgatttttgccgctaaaaatgcgtttgacgcatatttgatcatctcagcgcttctgatgtccgtatgatataccggaatcgcaagcggcgcgaaaacccggtcaagcgtttcccgcgtctgccggtcttcagccccgatcacgatgcggtcgccgtgaaaggtatcgtgaatcgccgaaccttcacggagaaattccggattcgaagcgattgaaatgttcacgtccgctctcagccgtgaatgaataacttcgctgattctgtcattcgttcctacgggaaccgtgctttttgtcacgacgatcgcatctttagaaatatgttcggcaatctgttcggcgacattttcaatataagtaaggtttgcgtgcccgtcttctttttgcggcgttccgaccgctataaaaataacgtccgcttccgcaagccctttttcgtagctcgtttcaaatgccagccgatgccggccgatatttcgtttcatcatatcttcaaggcccggttcaaagataggggacaatccctttctcatctgctcaaccttacgttcgtcaatatctatgcatgttacgtcatggccgatttctgaaagagacactcctgtcacaagaccgacgtagcctgttccgatcactgttattttcatcgtgttcccccaaccgtttagaaattgctgctgggcagcttaccgctattatcatatgatcccggcaccggcggaatgccgggagcctgaggtcatgataggaaaaaacggcgccggccgctgataatagcataagcataaaagaatcatcttgcaaaacagccgcttacgcttcatttaaacgggatggagacgacgattaaaaaagaccccagcgcttacggcgggccacaggcagcggaggttccttataaacggctttgttttcagcgagaagcgccgcattttccgtgagcatgtaaatcagctccgcccctgcttcttttttcagaacgctgatcgcctcctgataataaaaatttctcggtccgagattatgggcgtcagatgcgagaaagtggatcaaattcgcttccatcagctgcagcgaaaaggatttcgctttccgcccgaatgctccggcaatgcagccggccgtcacttgggcggccgcccctttcttcacaagactgtaaaggacggaaggattttcgcgaatttccctgttccgctccggatgggcgatgacggggacatatccgttcagctgcagttcataaaacagcctttcagcataggccgggacatgatccgccggaaattccgccagcacatactttgtattatggagcggggcaagcgagccgctttgaagacctgccagcagatctccgtctattctgatctcctggcctggcagaacagtcagcggaatgccttccttattcaaacgtttgtttaacaggctgaccgcttcgttgaccgtatgccgatccgtgtcatagcggtatttcacatgatgcggcgtcgcgatgatcgtatcaatcccctgtctgaccgcttctctcgccatcttcaggctttctgtatcatccgccgcgccgtcgtctatggaaggaaggatgtgacaatggatatctatcatatttcaatccctccttaaaaagaatggaccgcgcccattgtgacattattgtccgtaataggcgtagtccgaatgtttcgtttgtttcttcccgttcataacggccccaaggagcttgcacgggcagtaatcgagcgcttctttcgccttggccgctttttctttgtccgttttcccgcttgagatcaccataatggccccgtcagtgtagctgcctaatattttcgtatcggctacggccaaaacgggaggcgtatccaaaatcaccttatcataaactgcggctgcttctgacagaagatctttcatcgcacccgtcgataaaagctccgccggattgggcgggctcggcccgctcgttaaaatatccaagtttgcttcatcagccggcaggacggcattctgaaacggcatctgttttaacagcagcgacgttaatccggttccgttatccaatttgaaggtgaaatgaaccgtcggtttgcgcagatccgcatcaattaaaagcacttttttcccctgctgtgcaaatacgacggcaaggttggccgcggttgtcgattttccttcttccggaccggcggatgtgatcaaaagggacttcacctccgtatcaacggaagaaaattcaatgtttgtgcgaatcgtgcgatattgttctgagttgatggatttcggctcagacatcgcaatcacgcttcgttttccgggtttgtcttttttacgcgtcaacatgtccgcctcccgcttgtttggtttccgccatcctcaagcttttggcaacgctgtctttagtactgattgaagtaaccgttcccaggatcgggatgccgagcagcgcttccagctgttcttccgatttgatcgtattatccagatgttccagcaaaaaggcgagaccgattccgcccaaaagtccggcggcaaacgcaatcgcgatgttcagcttacggttaggctctgccggtgactggctgtccgacacttcggcctttgaaaggatgctgacattatccacgttcatgatggcggtgatcttgtcctgaaaaacggatgcaaccgcatttgccataacggccgcccgcttagcatccgtatcccgaacggcaatcgtcacgacttgtgaatcctgctcgctggataccgtgattttcgattccagctctttcgaagtcatggacagatgcagctgtttaatcacctcatcgaggatgaccgggcttttgatgatgacattatacgtgttgattaattggaggttggtttgaacgtcattgaattggacttctttttgattgtttttggattggctgaccaaaatttgagttgagttttcatagaccggcgtaagagcgaagaaactgatgagaccgcctgcggaagatgccgccgcggtaataataagtataaacagcagacgctttctcagtattgcgaatatttcctttatgcttgcagattctcccatataacctccatatcactttccgtgtattcccattccctccaatgatcttttccaattacgattatacagctttaaactgtcatttctaaccttttcaaatgacaaaattcgacaaaaatagacaatcacttcaatctgtattatatttgtaagcgctttaaatactggtgtcacaggaagattaaaaaatcccgcggccaggaggctgcgggattttatgttgcatatccatttttaatataagaaatcaaattctcaagcatttcttttgtggtcatctcagaggactgctcaccgatgtcgtgcgcatgcattaaaatcttcagaaactcctcttgatctaacttcgttttcttcatcattcgtttcctttcggcttccattaaattgaaaacaagattattatatgctgtcgggtgctgttttgcaatctctaatacatcattcgacacattcgggtttttatgtccttttttaggaaaaactttttccgggccatgtgttgcgatataatagaggaattggaatctttttattttgtgactcgttaggagcgataatcatgcttcaggatatgattgctaaagaagatgtgctcgcagcggctgaacagcttaaagaacttcttccttacaatgaagacaatgttcagctgatgaagaaagcactcattttatatcggcaggattccgtctatcgtatacaggttcaaaccccgacagagatttccgcatatgtgcaggatgttgtgcctgtaagggtcacgctgaacttatttttcatggtgaaaagcggctgcgcatgcccgtctgaggcgatctgccgccacgtgctcgccgtttttctttacgtatatgcccaattcgagcgggtcggtacctttaccgaacattggctggaaagagaaaagcttgaggaaagcagggagcttgtccgccggcagtttcaggaaaaagtgctgccgaatgaagagtcgctgtcaagctggctcgctttttttgattcggaattctcgctgtgggaggcgcggacgccggccggaagccagacgatgcagggcctttattacggctatctgtcagcgctcaaaaaacacgccccgaaaaaacccgagcttaaaagcttatatcagattcattcggcgcttgccgtctggcttcacatgttcactttgattgagtcaggcagattggatgccgaaaaagattattacagcattaatccatacgtggaacagctgatggatacgatttattcctccattgacagactgaaaacgtacgccttgtctttttcactcgatccttttttagaccggacgcccccggtgctccgcagactgcttgtgaaagaagagctttttcaatacgaacgcctccgggtattcggtgaaatgtggagcgcgcttttgaaccggccgaaatgggtcgcgcgtgaacaagagattctcgaacaggaaagcgggcgccgtttttcgccggaagtgcggttcggacggcttcatctggcctttttgcaaaaagatgatgaagcggtctttgaagatatgtcccgcttccctcctgaagcgctgccgtacacttttcaatggctcggtgaactcaccgcgaaaaaagactggaaacggctgaaaacatggtatggccggatcgaaccgcttgccgtgaactatacgaagcttgataagccgtttaaagaaatgcgcgacatcatcggagagctgtttgcgctgttggcggattatgcgcggcactcacgggatgatcagctgtttgaacggtttgcttccggctgccttccctatacctttaccgaatacagccagtacctgtacgaaaaacggcggtacgcggaatgggtggagattcacagcctcgtcggtttttccgtctgggaaattgaaaaggacatcctgaaggaaattgccgccagtgatccggaagcgctcatcccctcctatcaccgggcggcggccttttttatcgaccaaaaaaaccgcagcgcctataaagaggctgcgcgccatctgaaaaaactgcggacgctttataaaaaggcaaaaaaacagcaggtatgggagcgttatatcagccggctgagcgcaagctacaagaggctgcgcgcccttcaagaagaattgcagaaaggaaagttgattgatggcgagtcttaaggaaattttcattcatgtagaacaaatggaagattggacatttacgctgtcaagccatgatgagaaggagcagccgcttactctcagtcagatgaagactcatttgttccaatggcatgagtccaccttttacggaacgtttcttgaagacgtcagcttcatcggcactccggccgttctgctcagcccttggatgaccgtcgagctgcttggaaaaaactcgttcaattcattcagcaccgtgcagctgacaaaggaaacggaaccgttaatcgaagcggcttcgacgatatacgaatttattgccgacggcgattttcttccggattatgacgcatggcaaaatggcctcctgcgcttcaaagaccgcgagcttttgctggaaggctttacggcagactggttctcagccgcggtacaggactacattcagtacaatgatgacctgctggaaaaatggcggcggatcgaaacccgttcgccggccgttcatacgtttaaaggctcctttttggatgaagaggattttctggagggaatcggctggcatgacgatctgacgccgtttaccgtcggcctccgattaaacgagcctgatttcgacggtgacgactggaaaatcgagatgtttttacgtgagaaaaaaaccggctccatcacctttttcgacggactgaaagggctgaaaaaagcgtggcaggcatacagcggaaaaatcgcgcgtgaacaggaccgcttccgcagaacggttccctggctttcgtttgattcaggaacgacgctgatatctgaagaagaggcttggatcttcttatcggaagcgagtgagacgcttgtcgatatgggtgtggagattcttctcccatcatggtggcagattgtccgggacagcaatatgatgcttaaggcgaaagtgtcatcctccccgcggggcgagtccttcgtcggcatgaacgctctgcttgatttcaactggagattcgccacgaacgggattgagctgacagaggatgaattcaatgagcttgtcgcaaacaacagacgtctcgtcaacatccgcggccaatgggtgaaaattgatccgcaatttattaaacagatgaaaatactgatggaaaaagcggaatctgagggcctccacatgtccgacgtgctggcgcgcgaactgatggatcacggggaaaacggagccgaggacacggacatcattgactcatcggcatttgccgggatcaagatcgaattatcaaagcatctcagaagcctgatccgcaaactgacggatgccggggatctgccggagcatgaagtcagcgccgcgtttcagggccagctccgcccttatcagatgtacggcatgaactggcttctgtttttacgggaaaacggcttcggcgcctgtctcgcagatgacatgggacttggaaagacgattcagatgatcgcttattttctccatgtgaaggaaagcggccggcaaaaagcgcctgccttaatcattgcgccgacatcggtgctcggcaactggcagcgtgagctccagaccttcgcgccgcagctgaaggccgtgcttcattacggcccccgcaggccgaagggggaagcatttgtcccggcctatcaggacgcggatgtcgttcttacttcttacggcctctcgcacgccgatcaggaagagctttcttccgtgacatggagcaccgtctgccttgatgaagcgcaaaacattaaaaacgcgcatacgaagcagtcccgcgcaatcagaaagctgaaaggcgtccatcatatcgcgctgagcggaacaccgatggaaaaccgcctgacagagctttggtcgatctttgattttatgaacaaaggctatctcggcagtctgaccggctttcataaacgctatgtgctgccgattgaaaaagaccgtgacgaaaaaagaatcaaccagcttcagcagttaatccggccgtttttactgcgccggacaaaacgggatgaagaagtggcgcttaatcttcctgacaagctggaacaaaaagagtttatcccgctctcagccgaacaggcatccctttatgaacagcttgtcaaagatacatttgaacatatggcttctctgaccgggatgcagcggaaagcgctgattctgagcatgctcggccgcttgaagcaaatatgcgaccatcctgcgctctatttgaaggaagaacagacagagctgttaaacgggagatccgtcaaactggaaaagctgcttgacttaatggcggcgatccgcggacaaggggaaagctgcctcattttcacacaatacattcagatgggcaacatgatgaagcgcctcctggaaaaaacattcggagaaccggttcagtttttaaacggaagcctgtccaagcaggaacgcgattccctcgtcgaacggttccagaagaaagaatacccgacgctgattttgtcactgaaagcgggcggaaccggcctgaatctgacggctgccaatcatgtcattcactatgacaggtggtggaatccggcggtggaaaaccaggcgaccgaccgcgcctaccgaatcggccaggaacggttcgtccacgttcacaaactcattacgacgggaacgattgaagaaaaaattgatgccatgctcgaaacgaaacaaactttgaacgatcagattatccaaagtgaaaattggattaccgagctgtcatccgatgagcttgaagaattattcaccctcagcgcatcgacgcaatcacattaaacgcaaaaagaccggctctctcggaagagccggtcttttatgtcgtccttactgttacgccgcatttgccatgaatgcgtcacgccagtcatgaacagtatcgccatacctttcacagtaaattcctgatcatatacgcaacgccgttttgatcatttgtcaatgtaacggcatcagcgatctctttaatatcttctctcgcattccccatcgctatgccttttccggccgcctgaagcattgaatagtcatttaagctgtcaccgaccgcggcggtttcagccatcggaatgccgagcttttgcgccagccgtttgagcgcctgcccttttgaggcgtttcgagacgccacttcaaagttgtgatcggcagagctgacaagggtgagatctttctgaccgctgaatcggtcccagcccgctttcagcttccgctcatcaaacgaaaatccgagaatattataaaaatccagatgctcttctttctcaaagagctcacggtatgaatgaatgtaagcaaagccggactggctgtattgcactgaagccgcctgttccaaaacggaaagatcggtttccggattggcgcttttcacccggtccatttcgatatcgagcagctgcctgccggtttcaggcgtatagatggctttgtttgtaaacacctcataataatattgattctcttcaagccatgacaaaatcccccgggctcttgtttcttcaatcgcttcacaatggtacaggctgccgtcaggagcgtggatggcggctccgtttgcgctgataatccatgtttttatgccgagcggttcaaatatggagtgcacatcaaaatgcgcgcgtccagtggaaaccacgatttcaattcccgcttgccgggcttcccttaaagcccgcttgttttcatcacttacttgatgactgctgttcagcagtgtgccgtccagatctatggcaatcagtttcacatgtcctcatcctcttcttcagattcagttacaagcaattctacgccgtgccggtcgagcagatcgcaaaaatcctgatcaggcagccgatcggtaatcagcaggtcaacctcgtgcaggtctgcatactgataaaaactcgtacggccaagcttcgagtgatcgctcagcgcaatcacctgttcagcctgacggatcattttacgctttaccatgccgtcttcttcatgcggaatcgtcaggccgttttccgagatgccgacaacgccgatcagcaccttatcagcgtgataatcccccagtttttctacaacggaagccccgtataaaaaccggtgttccttctggagctttccgccgagcaggtgaatatcaattccctcttttgcggaaaggatatcggcctgattgatcgaatttgtaataacagtgcagccggtgacatttaaatgctccgcgcaggcctgaacggttgtcgatgtgtccaggatgatccggtctcctttatgaatcagggatgcggccagcttgccgattttgtttttctcttcagaaacggttttcagccggcccgaatagcccggaacttcctgattcactgacggcagaatcgcgccgccccgtgttctgataatggcccctcgctctttcagctttacaaggtcccttcttgcggtatctcttgaaatatgaagcagcgaacatatctgttcagcggtgatccgccggtgctgtttcaaatattccattatcgcaatcagtctttcttcttgatacacgtcctcattccctttttttcgtcacttatctgtaagtaattataagtttttatcccaatatattcaatgtttttaagtatttataagcgaaatcacttctttttaaccatttttcagctcccgcacaaaaaaaccagtctttcgactggcgaatgggaaggaggtattgcggggcccgctgaaaggcgggaaatcgaggaaaaaagcatgctattcagccagcggctctttccgtttttgatccataaaccgaacggtatcagccatgacctcggtcacataaacttttacgccgtctgtcttttcatagcttctcgtctggattctgccgcttacaccgaccattgaccctttttggcagtacaatgccgtgttttcagcgtttttcctccagatggtgcagttgacaaagtcggttccggtttcacccgacgcgcttttaaaattgcggtttaccgccaacgtaatatgagcgacgggaatgcccgctgatgtaaaacggagctccgggtctttcgtcagccggccgacaagcataacgtggttaaacaagccgtctcctcctctctttttcgaggctggcttcattgtagtataaaggcttatgaaagcaaaaagcggaaaaagcctttatccgtttgggctgcttttatgtttttgtttttctttctgataaaaaaaacttttgtttttgaccgcttatgtaatatgtatttttgagcagccgcgagaaaagtttcgttttgagccagtctttctcaaacatgcggacaaactttccgccgtcccatgcgaaccagtaaaaactcagctttttatcagtcaatgaaagctgaattttatactgttccatgcggtcttttgtttcatataaaaagacgacatttccccttctgttaagatgcacctcacaatcttcctttttgcataccaagtaggaatgatcgtcttttcgccttgaaccgtcttctatatagatttccttcaggcgcaattgattcataagcatctctccatgaccatattcttttacattataatgaaaaaatagaaatgattaaatgttgaccgcctacaaaaatgatgaagcatgtcttacagcattttcccgggaaaaatgatatgtgttataataaatgaacgaaaaacatggacaacaggggtgaaaataagagatgaaaacctttaaactggttgatctgaatgtggaacgtttagataaagacgatcagccgattgaacagtttccccttttagacggattgattatcaacaaagaggacggagaaaaccactggttaattgaagcactggtcccggccgaacacttttctttttttgacatgctgatgaaaagccagaaagaagcgaaggtgtttgtaacgattacgaaaaaaagcaaccgccccgcccagctgacgggaagcatcaaaaatattgtggagctggaaaagagtatacaagttttaatttacggtcaaatggtgtcaagaaaccaccccggatcagaaagcattctggagtcgctcgtgaaagaaggctactcgggcagccggctgattgaagcgtttaaacaaaaattataatcataaaaaaggccggacgttaatcatccagcctttttttgtgccttagtcattgtgaggagcccgctgtttcagcagatctctgatttcagtcagcagttctgtctgctgatctgtttcttctgcttcttcagcctcttcttctgcttcttttttacgtctcagcttgcctattgtacggatcacgataaagatagaaaatgaaataatgaagaagttcacaatcgtttgaatgaagcttccgtacttgatatgagcatcgccgaatgtcacggccagccctgaaaagtcaagaccgccaagaagcaggccgacaagcggcatgatgatgtcttcaacgagcgacgtcacaattttgccgaaagcgccgccgatgacgacaccgattgccagatccatgatattgccccgcatcgcaaagcttttaaattctgaccacattacattcacccctttctatacaaaatgggcttttttataagcccattcgtttgtttttattctccgagcgcaaatgttaattcagcttcacacacgagctcgccgtcaactttggcaacgcctttgccgcgtccgatcgtaccgcgcgcgcgggtaatatcaacctcaagctccagcttgtcacccggttttacctgctttttgaaacggcagttatcaatccccgcaaaaaatgcgagtctgccccggttttcttctttaatcagcatcgcaaccgctccgacctgcgccaaagcctctacgattaagacgcccggcataacagggtattcaggaaaatggccgttgaaaaaatcttcattcgccgtcacatttttatatcccgccgcccgttttccttcttcgacttccgtaattctgtctaccagaagaaacggatagcgatggggaataatttctttaatttgctgagtatcaagcattttcttgacatctccttcatcgacaatagtatgtatagaaggtatatgcgctaaccaatctgtacatttggaagtatattatgaatcaatttctttttcaaccgcgctgtaaactgtaaccagctggcaatgagcctcgtccattaatgtgttatgataaataaagatttttaccctatgcaaagaggttggaagatgattgctaagtttactgaaaaacgtacgctggtgatgctgaatgagtggtatgacgccatgggaaaacgccaattcgatctagcccgttcccttcacgaacaaatcaatcagcatctccccaaattacaaaagaatgcaaagctcaaactcagatatcagctgtttttcgcacggtttcagctgctgtttgagaaaaaagacggtctgactaaattgttctgcgagctgaagcggcgcaaagatgagatggaccatgaattaacttattatttctattttttcaaagggttattccatatggtgaatggcgctccgaaccgtgctgtctgccgctttaaagaagctgaacagtacctgccggccattcaggaccgtttcgaagccgctgaattttattataaaacagcgggtgcatattacatgatgaagtcgcctgcgctctccattcaatatgtcaataaagcgctggaaatctatcaaggtgaattcggttacatcaaaaaaacgctcagctgccgtctgcttctcgccgtgaattacatagacgaggcacgctatgaagacgcagaacagctctttaatgaatccataaagataacggaccggatcaatgacaataacctgctgtgccacgcctattataattttggttttttaaagaccgcccagaaaaaagataaagaggccctccctttttacaaaaaggtattgggcaatcagcgtttcgagaaagagtctcccgtttcctacctgcattgtgtatacgaagcggtcagagcactttttaaaaccggatatgccgccgaaggacaaaccgtgctgcagaaaggtttatacatatctgaaaaagtgcagaacaagataatgaaattgaagctgaccgcgctcaacatactgtacaccgctcaggaggacccgtacgaccgattgcagaaactcgtgctggagctgcagaaaattgaagcgtgggtggatttggaagtgctgcttcaggatattactgattactacaaaaaaaagggcgattttgagaaagccgcattttttatcatgcgcggctgatcaaaacgccccttcttttatctgactgagttgattaagcccagcatttggtctcccaatgtaatcgtgcggctgttcagctgataggaacgctgagacacgattaggtcggtcatttcttttgacatatcgacatttgaactttcaagcgcgccctgctccatgccgattgcctgccggtttgcgccggtaagctcttcaatcgctgatgcccccgctccgtttacggaaaacagattatccccttccgcatgaagggcctgaggattattgacattgacgatgccgagattaaacgtctgcgaacgggttcctgccgggtctgaagcagtcagcgttccggttttgctgattttcagctgattcagcgaactgtcaatttgtatgggctggccgttctcatcgagaatgggattgcctcccgctgtcaacagctgaagcacccggtcatttccgccggccggcttgagggaaagtgagccgtcccttgtatacacccgccgtccgtccgcttctgcctgaagatattgataaggtgaggtgaacgcgatatcaaggtcacggtcggtttttttgatgcctccctgccctgagtccagctgcggagtcatgaccgttccggcgccgagacgcaggccgggcggcgttttccgcatgttcggcgaattttcctttttgtcatctatatggtcatactgctgtctgatcagctcggaaaagcgggagtccctcgctttatagcctgtcgtatcactgtttgaaaggttgctgctgactgtatccatctgctgctgaagctgatttaaggctgttgaagccgtcagcattgatctgagcatcataattgaacgtcccccattttgttacactttgccgatttcatttgcggctttatccatgcttttatcgtaagcctgaatgactttctgattggcttcaaatgatctgtatgcttccgtcatttctgtatacgtgctcgtcacgtccacattcgaaagctccgagacgccttgctttaatgaatacgagacctggggattcgccgccgcgctcggcagttcagtgccgtcggccgtgctgtataggtcattgccgtcccgtttcagattgcgcacgtcttcttccatcctgatgtcaatctgccccgccggccggccgtttgtcgtgaccgttccgttttctgatacggtgaatttttcattgtcgactgtaatcggctgtccgtttgttgataaaacaaggtttccgtttatggtaagctgattgttttcatttaatgagaaagtgctgctttttgaatagcggacgccgcccgcagtctgcacgggataaaacagctcggcgttttcattcgtttcggcattcttgggaacctgattctccataagcgcgatatccgtcggctgatcggtcgttttcaggcttccctgcgtaaacaacggtttcagctcctgcatgtatacgcctgtgttgacggaaccgattttcgtttttttatcgccttctattcggctcagaagcatctcgggaaaggcgcggattgaaccttgatcctctttgtatcctgacgtattcgcgtttgcgatgttatttgacagcatttccgttcttctctgctgtgtaatcattgcggacgttgcggtatataatccttttaacaagtcttccacctctgaaatagcattatttccagttgcctcaccggaacatttgttctataatgaaaatcagcattttttcttattatcggatttacattcccgttcgtgaagggtttgacagaaaaaaaccccattctttttcagaatgaggttttatcatcagctcagtttgcgtttcggaagcttgtccatgttatccagcatgacgccggttccgaccgcaacacaatccatcgggttctcagcgacaagaacaggcaccctcagctcttcggcaagaagctggtcaagcccgtttaacagcgctcccccgccggtaatgataacgccgcggtcgatgatgtcagcggacaattcaggcggtgttctttcaagaacctgcttggcggcctgcacaatgacggcaactgattcacgaagggcttcttccacttctttgctgtttactgtaatcgttctcggcaggccggaaaccatgtcacggccgcggatggtgatttcttcatgacgtgcgtctgggaaaaccgttgcgaccttcaccttaatatcttcagcggtacgttcaccgatcagcagcttatactcgcgtttgatataatttaagatttccatgtcaaacttgtccccagccatcttaatagaagaggaggtgacaatatcgcccatagaaataactgcgatatctgtcgtaccgcctccgatgtcaacaaccatgttaccgctcggctggaagatttccatacccgcgccgatagcggcaactttcggttcttcttcaaggtacacatgctttccgccgcttttttcagctgcttctttaatcgctttctgctcaacggatgtaatattcgtcgggcagcagatcagcatacgcggttttgagaaaagtccttttacattcagcttattaatgaaatgtttcagcatagcttcagttacttcgaagtctgcgattacgccgtctttcagcggacggatcgcaacaatattcccaggtgtacgtccaaccattcgtctggcttcttcaccgacagccagcactttgccgctgtttttatcaagtgccacaacggaaggctcattcagaacaattccttttccttttacatggatcagtacatttgcagtaccgaggtcaattccaatatcccttgcaaacatctatttatatcctccttgatatctgtttcacagtaaaatatccacattgtgccctaattatatatattatcataatttatcaaaaaaaagctgctgatcgatataagttcttgacaaaattttgcggatattcgcgaaaccgcccggaggagaaaaaagggcccggcagacgtcaggcgctacggctgctgaacgggctccccttcaagaatttcatccttcttgtactttaatttcgtcgcctcgccccccttaaatgtctgatggatttatgataatcgagtatttcttttacttcattcgccaagtcaggattgatttcaggcaggcgttctgtcagatctttgtgtacggtacttttggaaacaccaaactctttcgcaatgacacgaacggtttttttcgtctccacgatatacttaccaatcttgattgttcgctctttgatgtaatcgtgcacaccactcgacctccccagttggatgtgagaagtgtgaaatgagatccgtattctgtaacagattcactgatgatgcagcttcttcgttgtccgattatataagaaggttttagaaatatgcccacgatccctcacctcaaacactctctttgataggtttgtaacagtgtattagcaatgaattgggaatatgctaaaaactcaataaggacaaggggcgggtcataattttctgctttttgaacggggggtttacatccgcgcgatcctgctgtagaatgaaacagcacaattagttacttaggtaagttttttgaaaaggagaacggaaatgatccacgtcaacagacgcctcattcatcaaatcaatcaatgcgcccgcctgattacgaagaaagccaatgaacggctggaaccattcggcctgtactcctctcaatggtcaatcctatattgcttaaaaacgatcggaccgatgacccaaaaagaaatctggtcttatctgaacgtagaggcgccgaccgttaccagaacgatcaaacgccttgaagaaaacggctggattcagcgggaacagggagaagacaagcgggaaaagctcgtcgtcctgacgaaggaagctgaattgaaatacaacagcatcaatcaagagatgctgaagttcgaggaagacatgcttgcggatttccaagatggagataaggaagctttttctgagtttctgaatgtgtttttaacgaaataataaagaaagggaagtgctgtacttttgagtaaatctgactcgatctggaccaaagattttattatggtcgtactcgtaaatttatttgtctttgtgttcttttatacatttttggccgtgctgcctatctatatgattcaggagcttggcggcagtgaatcgcaaggagggcttttgatcagcctgttcctgttatctgctattatcacccgtcctttttcaggggcgattattgaacggttcggtaagaaaagaatgacgattgtatctctggcgctgttcgccctgtcttcttatctgtatttgccgatacacaatttctatctgctgctcggactgcgttttttccaaggcatctggttcagcattttaacgacggtcacaggcgcaattgccgctgaccttattcccgccaagcggcgcggcgaggggctcggttattttgcgatgtctatgaaccttgccatggcgatcggtccgtttctcggactgagccttgtgaaagtcatatcgttcccggtgttctttacgctttttgctgtatttgtttctttaggcttgctgattgcttttatgattcgtgtgccggatcaaaacaacagcggaacgactgtgttccgtttttctttctccgacatgtttgaaaaaggcgcgcttaaaatcgcgattgtcgggttgtccatttctttctgttattcaagtgtgacttcatatttatccgtttatgcaaagacgatccacctgttggatgtcagcggctatttcttcgtctgtttcgccgtgacgatgatggccgcccgtcctttcacaggaaagctgtttgacagagtggggccgggaatcgtcatctatccgtcgattatcgtgttctccgcggggctttgcatgctggcgatgacaaacagcgccctcatgcttctcttgtccggtgccgtaatcggtctcggatacggctctatcgtaccgtgtatgcagacgctggcgattcagaattcgcccggacaccgttcaggctttgcgacggcgaccttcttcactttctttgacagcgggattgccggcgggtcatatgtattcggcctcttcgtcgcttcggccggattccattcgatttatctggcagcggggctgttcgtcctgattgctttgctcctgtatggctggagccagaaaaaaagaacgccgcttgaagcggacggaaacgtttcaatcgcagactgatatgacaaaaagccgggggcagcccccggctttttttattcggccgctctttcccgcacgattcgtccctccgcttttgcataaggaggatgaatgtacataagcgccgtataaccgagacatgacaaaatgacacccgcaaaccaggagatatcatagatgccggcgaacgccgggacgtacatcccgattaaagaaataaacgcgccgagaaacgtcgcggcaaaggcccggtaattatagcctttgtaataagtgtactgtccggtttctgaataaaggtcttcaactgagagctgcctttttctgatgataaaataatcagccatcatcaccccggccaccggtccgagcatcccgccgatgagtccgagaaacgcatatacattcgtggcgctctccatcagcttccacggtattgtgaacagagccaaaacggcggtcaaataccctccccttctgaatgtaatatacttcggcaggacattcgccaagtcataggccggtgacacgatgtttgccgccacgttaaccgagacggcggcgatgcaaagtgtgatgaccgaaagagcgataacgaaaggattatcaaaccgggccaaaatctccaccacatcccagatcggttctccgaatgctacctgtgatccggatgtcaccgtgatgcttgcaaacgcaaacagcgcaaacgttcccggcagcccgtaaaactggccgcgaatctgttctttttgcgacgcggcgaaccgggtgaagtcagggatattcagaatcagcgtcgcccatattccgataatgcccgtcactccggcggcaaacggccaaaacgtttcagaaaatgtatggaactttcccggctgtgagtaaatcggaccgagcccgccggcaatatctatcgcccaccagaccatgccgccgaagacgagataaacaagcgggcccgcccacacttcaaattttttgatcgattccatgccgtgccgcagcacaagcagatgaatgccccaaaagaaaatgaacgacagaaagcccggcagatgaagcccgaatatattccaatctccgccgagactcccccagcccggccatatgttcaaaagcagaatgtgtaaggcagtgctcccggcaaatgtttgaattccgagccacatgatggctgtaaatgccctgagaagcgccggaatgttagctccgtatattccgtaagaagccctgataatgaccggaaaaggcaggccgtatttcgttccggcatggccgttcaaggccaaagcggcgaacaaaatcagtgacgccgtcacgataatggcgagcacctgccacggagaaaggccgatcgcaatgagcccgcccacagtcgcgtaggtcgggatattatgaatacaacccatccagatggatgcaaaattcaccgccttccatgtccgttcgccgtcttctaaaggcagtaaatctttgttgcttagccgatcactcgttatttttgtcattttctccctcctgcatgtacgttttccttacatcacatgtgaaaaaatataactgaaaattccgcaaataacattggtcgctgtcgacaataatcgttttgatttttgagcacattacacaaaaaaagagacggggagagcccgtctcttttttttgcgcctgttaagaggcttttttgaggagaaccgaaaaccggaacgccatcaaaaggcttacggcgccgacaacgataagaatcgtgccgagcatatgaaaatggccggcggtaatttcttttccgaaaagaatgcccaaaatgacagaagacaaaatcgaaccgagatacctgcaggtctgaaacaggccggacgttgttccgaccatgtcggcggggctcgttttcagcatggccgcctgaaacgtgacatttccgaaaccgtagccgacacccagcacggacaggatcagcccttttcctatcatgggcgcctgaaggaagaaaaacgttaacagcaccgctccgatcgcggtcaggcaggttccggcaacaatcggctgaagaagccctttcttatctatccattttccggtcaaaggcgacaccagaatactcatgcccgacataaacagcataatcaatccgcttgtctgaacggacaaatgcatttcatcctgaaaatagctcggaagcccgaaaaagatgcagtaaaagaatatattcagcaaaataaattgaatatacaccgacgatagtttccgatgcgttttaaacagcctgacatcaataaacggcttctctgttttcagctcacgccagataaacagcccgacaaataaaagcccgaatacgccttctgtatagtgaggcttcgtactgaaggacaataaaaacgacaggagaaggataatcgctccggcaaacaggagtatcccgattgtatcaagctggcggagcacgcctttcaagccgccgatctcgcgtttttcatctttcggaaacatatacattccgagaaaaaaactgaggatgataaacggcagattgacgaaaaagatcgccggccaccctccccaaacgatcagaaaaccgccgagagtcggaccgagcgccgtcatggctgatgcaaagattgacaggacggccagcgccgaagcctgcttctcctgtatatttgaacggatcaatccgacgccggacggatatatcgcgctgcttccgatcgattgaaaaagccgcatgatcagcaatgtcataaaagtcggcgcaaacggcgcgccgaccgccgagacggcaacaagcagaagcccgatcaaaaacagcttcttcctgccgagcatatcaccgagcttcccggtaacaggctgcgccaccgcgctggcaagataaaaggacgatatcagccaggacaccgttgtaaacgacaggtgaaattcatgctgaatactgtgaagcgcaagagaaatcatcgacgagttcaatgggttcagcatcgtccccgaagccacggccgtcaagaacaggacgcggctttttttggagattgtcattttgtctgtgcgataaattcttccgtcgtccggcttctgccgattttcgggaagataaatttgagtgtcgcttcgtgctgttcatcgctgaatgtcgccatcgcgtcagttacgaaaacttgctgatacccgagctgaaaagcttcccgcgccgtgctttccacaccgatgtttgtcgcaatcccgcataacacaatcgtgtcgattccccgtcttctgagctgaaggtccaggtccgtgccgaaaaacgcgccccactgccgttttgttaccgtataatcgttttctttcactccgatttcaggcacaaattcagcccaatccgccggcggagccgaatggcccgccgcctcttcatccgtcagcggcttcagcgcatccgctccgtcatgaaaatctacgttcacaaagctgataaatccgcctttttcccggaacacatcaattaattttttcgcgttcggcacaacggtaccgcttttatccatcggcacaatgcctttttgtaaatcaataaggaccaaagccgttttttcaaattgcagattcaatgatgttgtcataataattcctcctgatgcagttagtgtttctcaccccgtttattttactctttcccggacaggatttcttccgccatgctccagcgctctttttatggatataaagtcgcatgacacccctttgaaaaagcgacattatgaacgcaaaaaaacatgtcagataaccttacacgaaaatgttttatcgttcttttttctctataataatgaattaatcacgattacattttgaatgagacggaggaatacaacatgcagatgggcgatacagtatttatgttcttttgcgctttactcgtgtggctgatgacccccgggctggctttgttttacggcggaatggtaaaaagcaaaaacgtgctcagcacggcgatgcacagtttttcttccctcgccatcgtatccgtcgtttgggttttgtacggatattcacttgcttttgcccccgggaatacatggcttggcgggattgaatgggccggactgaagggggtcggctttgaacccggaagttatagtgatacgatcccgcattcattattcatgatgttccaaatgacgtttgccgtactgacgacggccattatttccggagcatttgctgaacgcatgagattcagtgcttttcttgtattttcctttttgtgggcttccctcgtatatacgcccgttgcgcactgggtatggggcggcggctggatcggccaaatgggcgctcttgacttcgcaggcggaaacgtcgtccacatttcttccggggtcgccgggctcgtgctggcgattgtgctcgggaaacgcaaggacggcacggcggcttcgcctcacaacttaatttacacgttcttgggcggggcgctcatttggttcggatggttcggcttcaatgtcggcagcgccctcacgcttgacagtatcgcgatgtttgccctcattaacacaaacaccgcggctgcggccggaattatcggctggattttaatcgaatggatgctgaacaaaaaaccgaccatgctgggtgctgtatcaggcgctattgccgggcttgtcgccattacgccggctgccgggttcgttacgccgttctcttccatcgtaatcggtttcatcggcgggcttgtctgcttctggggcgtgtattggctcaaaaagactttcggatacgatgatgcgcttgacgctttcggcctgcatggaatcggcgggacatggggcggcatcgcgaccggtttattcgccaccacttccgtcaatgacggcggggcaaacggactgttttacggcgatccgggactgctctggaagcagattgcggccattgcggcaacctatgtatttgtatttattgtcactttcgttatcattaaaattgtaggtctgttcattcccctccgcgccagcgaagaagaagagtcacttgggcttgatttaacgatgcacggggaaaaagcatatcaggacttataaagtgaggagtggcttagatgagcggtcaaatgttcaaggtagaaatcgttacgcgtccggctaagtttgaaacattgaaacaggaactcggtaaaatcggagtcacatcgctgaccttctccaacgtacacggctgcggccttcaaaaagctcacaccgaactgtaccgcggagtcaaaattgaaagcaatgtatatgaacggctgaaagtggaaatcgttgtcagcaaggtcccgttgatcaagtggtggaaacggcgaaaaaagtgctgaaaacgggagagcccggcgacggcaaaatattcgtctatgaaatcggaaacacgattaatatccgcaccggagaagaaggaccaggagctttataaacagacagaacgcccggagacagcatgtcccgggcgtttttttcgggcttcattaaaaagaagaagcctttttttcatgcggggcaggacgcttatgccgtacggtttgttttttcgcatatgtactgatattgaccagtatgccgcacaaaaacagcgtcataatcaatgaagaaccgccatagctgataaacggaagcggcacacccgtaaccgggaggagtccgctcatcgctcccaaattcaagacaacctgaaacattaattgaaacgtaattccgatggcaagaagcttcccgaacgggtcatcagcccgcacggccgtttttacgccgagaagcattaacgcaaaatataatcccaaaacgatcagaacaccgaatatccccagctcttcactgatcacggccataatgaaatcggtatgcgcctcaggcagatagttcattttttcaacactgtttccaagccctcttccgaaaaacccgcctccggaaatagcaaaataggattgaatcagctgatagccgtccccgttcgcgtcaccaaacggattggtaaaggaaacgaggcgcttcacacgataggatgcagaaaatgcgagataaacaacccccgacaccgccgtcgcgccgagcacgaaaagatggcgctttttcaagccggcacataataaaatcgacccgcacgccgccaggattaaggaagccgtccctaaatcaggctccgccaaagtgagcagaaaagcggtccccaaaattactaaaggcggcagaacccctttcacaaattgatgaatgtacggctgctttttcgtataaaccgaagcgaaatacaaaatcatggcgatcttcgccaattcagacggctgtacgacaagcgggcccgctcccagccacctgcgggaaaaattccgctccagcccgattcccggtatcaatacgagcagcagcaataccagcgaaccgaccacaaacagcggtacaagccgcgcataccgcttatacggcagacaggcggcaaatagaaataagcataatccgatcagtaaagaggcactttgtttatggaagaaataggatggatctccgtaccgctgagaccccatcacatcactggcgctgtacaccattaacaagccgaatccgcaaagcagcataatgacaaacacaagcggcagatcggcgtttttcaaacgtttcagcaacggacaaaactccttcggctattcttttcccgcatacttgacgcacagtaatacagtcacgtttcattctgtttacttttttatgattatttttaataccaattgtgtctcatagaaaaaagcattacactgttcatataaaataaagataaaaggtgatatttgtgaattacgaactatttaaagcgatcaatggtttgtcgcaccatagtgccattctcgactctatcatggtttttataacggaatacgccatttacgcctacgcccttttcctgcttgccatgtggctgttcggaagcacaaaaggcagacaaaacgccctgtacgcgggcttcacgggtgttgcggcgcttatcatcaactacctcatcacgaaagtctatgtcgagccgcgcccctttgtcgagcatacggttcatacgctgatccctcatgccgcggatgcttcattcccgagtgaccatacgacaggcgctttggcgatttcaattgcgattctgttccgcaacaaaaaactcggctggccgcttgtgattttcggccttttgaccggcttctcaagaatttgggtcggccatcattatccgatcgatgtgctcggaagcattatcgtttccctcattgtcggattcctgctgttcagattttcaaatgtgcttcgtccgattgtcgatctgatcgtgcgaatctatgaaagtatcgttcataaaagcaaatcgacaaaccataatatataaaaaaagccggcgtctgtcacagactgccggtttttgtatgtttggctgtatgctttttcctttgtaaagcccagaatgcggcaatgccgagactgtcaatcagcacatcgcggaggcatccgtttctgccgaaaaagagctggacgatttctgtcaggaaagcggcggccaatgcatacagcaccgccctcttcatgcgcctgcgctccctgaaaaacaaataggcgagcacaaaaaatgaaaacgcgtgcccgagcttttgaatcgccgcttccggtatggcgagctccgccatatcgaacacaaagaaaccggacacatccggatgggacgtgaaacggaaggacaccgtctgcgacacaatcatatcgtgaaagctttcagtcaaagcagaaacgaaaacaaagacgagccacccggccgccagacatttattcattcagcatctccttcgttttctattagtataaaggcacatgcagcaatatgaaaagcgcctatcagagctgatagacgctttgggatcaagattacttgcccgaatctttcattgagccgtcatctttaccatctgtcttgtcttttgtgccgtcttctttgtcacctggtttttcttcggtttcttttttaggcgtcacatcttttttctcggaagactgctgaattgacccttccgtttcttctgtcacagcgtttttctcttcagccgccgctttttcaatagatgttaccggcttgtccataaaattgagcgggttcatcgctacgccgtccttgcggatttcaaagtgcacgtgatttccgctttcttcactgtaaagattttttccggatttaccgatgacctggttctgctttactttgtcgccctggtccacgctgacttcagataaagactgatagacagtagacaggccgtctgagtgttcaatttcaaccacataccccagtaccgggtctttagcagctttaacaaccgtaccgctcagagaagcagaaacatcaaatgattttccgtctttctcagctaagtcaattcctttactgaggctgtacgtgttattatagttaacaagtgctgcttctttctctttttttgcggcatcagattcgtaaaactttttcacaacagaaacattttcagaatgagcagccggcattgcgacgttttccattgacttgcctacttcgacggcatcgtctttgccgctgtcatacgcggagtttccgccgttgttcgtcagattgtccttcacatcattcgaaacggattgataccaaaggacagctgttaaaatgacggccgcactgactaagtagattgcagggaatatccagcgtttgcgaaaaaaccgctgaagttttttgacttgagaagttttcttttcttcctctctcatttgttcatcacctcagcaacattctgaacacttttctgaaaatatatacacatccataaaaaacttttttagaagtagtatgtgcagattgcacttaattatgtaatgaaatgtgaagggagatcccggaatatgaatttaaccctgcgcaaagccgtattggaggatttagatgcggtggtggccatatacaactcgacgattgcctcacgaatggtaacggctgatacggaagaagtgacgcccgcagaccagatggattggtttttgcggcacacggaccggcgcccgctgatggtcgcggaagatgaaaccggcaaagtggcggcctggatcagctttgaaacgttttacggccgtccggcctatgacaaaacggcggagatcagcatctatctgcatcaggattgccgcggcaaaggagcaggaagctttctgctgaaagaagccctggcactcgctccggcaatcggcatccgcagcctgatggcttttatcttcggacataatgtgccgagcattaagctgtttgaaaaattcggttttaccgaatggggcgtattcccgggtatcgccgaaatggacggaaaacgatatgacttgaacattttagggagagaactgtcatgatcaccatcgataaagacaaagacgaaaaccagccgctcaataaaaaagcccgttcccttgccgacatcgccaaatggggaaagatcaccgccgtgtttctgatcatcacaggttctctttccgctctgtcagccattgtgacgctgctcggagccattccgggtgttctgctcatcatttccggcgtcatgctgatgcgctcggcaaaagcggctgccgcccttcaggaagggctagaagaaaacgcggaagaaaatatgcttgcacattatgcgtcatttatcaaaatgcagtttttttacgcggcatccagtgtggtactgggcattctcgcttttattttagtcgtcatcttcgctgtcatcggaattatggcttattacagcactgatacgtatgacacgcctgattcatattactatgagaacgatcctgtgtttgaatgacaaaaagagctgatcgcgcgtcagctcttttttaatacagcatttcttttttccggtcttcttccgttaaaaattcaataaagctcttcatcgcagacggctcctcggcaatcagccgggtgtaggcgcttttccgttcctcggacagaatatcgctttttctgattctgttcagcatataaagccggatcgttttttgcacctgtttccgctgatagccggcttccttaaaaaacgcaagacccagagccgcaaggagggcaaaaatgccggccgatacgagagctcctctcccggaaggggcctgaatcaaaagcgatgccagatgaaacagactaaaagcggcgagcgggaaagcaagaaaacggtaaatgatgctttttttcatcagcggcgcgatggcgatttgtattttctgaatttctttttttatgaatcccggcaattgttccgcatgctccagcttcatgccctctcccctttgctgtcatttttgtcttctttttcatatatgcatattttaccgcacccggaactttctttgaaagaaaactgcattcatctttgattccggctctttattctttcaaaatgtcaatgttataatttgaaatgggaatcagattgctgcacttgtcggaatactaatgggcacagtcttgataaatatgatatagcggggttgcaaagtgagcatttcatttattttattcggattttttttcgttttaaatatacttttggccgtcatcatgattttcaaagaaagacgcgatgccagcgcttcatgggcttggctcttggttcttttttttattcccattttagggtttattttatacctgttattcggccataacctgagacgcaagcacctgtttcaatgggaagaccgtaaaaaaatcggaatagaaaagctgctgaagtttcagctgaaagatctgaagtcgaggcaattccaatttaacaacagggcgactgtggataataaagacctcatctatatgcttgtcatgaacaaccacgcagtctttacagaggataattcggtggagattttaacggacgggcgcgataagttcaaacgcttaatgaaggacatttccaacgcaaaagatcacattcaccttcaatactatatttataaaggtgatgaactgggaaaaaaattgcgcgatgccttagtgaaaaaagcacgggaaggcgtaaaggtcagagtgttatatgatgaactcggttcaagatcactcagaaaaaaattcttcaaaccgctgcgggacgccggcggccatgtggaagtcttttttccttccaggcttcgtccgattaatttgcggctcaattatcggaatcaccgcaagctcgtcatcattgacggcgaaaccggctatgtcggcggctttaacgtcggagatgaatatctcggcctgaatccgaaattcggctactggcgcgatacgcacctcagacttcaaggcacggcggtacacgccattcagacacggtttattctcgattggaaccaagcttcccatcaccatacgctcacttacgttccgaatcattttccggaatgcgagccgaagggcaatgtcgggatgcagattgtcacgagcggaccggattcagaatgggaacaaattaaaaacggctatatcaagatgatctcaacggccaaacggtcgatcctgattcagacgccttactttattcctgactcaagtcttttggatgccctcaggatcgcctgtctgtcaggcattgacgtcaaaatcatgattccgaacaagccggatcacgctttcgtttactgggcgactttatcttacatcggcgatcttttgaaagccggagcctcagtctacatttacgataacggctttattcatgcaaaaacgattgtcgtcgatgatgagacggcttcagtcggtacggcgaatatcgacgtcagaagcttcagacttaattttgaagtcaacgcctttatttatgacgtcaccatcgcgaaaaaactcatttcctcatttaaagaagatctgctcgtctccagaaaatatacgtatgaagaatatcaggagcgttcgctgcggatccgcattaaagaatcgatttcaaggcttctgtcgccgattttgtaattcccgggatgtttctcgggaattttctgatataaaaacggacacagcttgaaaaaacacattttatattcaaaagaatgaccgaatagtgtataaatgaaaagtgagtatttttttgtaaaggagtgccatggtttgaaacctgaatcagtgaatcgttcgcttatttctatttcgaaatggggaaaagcgacaggtattttgtttattattataggcgcgtttgcggcgctttcgggcgcgtttttctttttaatcggagccattcccggcgttctgcagatcattgccggcatttttctgatgcgctcggcaaatgaagcgggacagatggcggcgcagttcaatgaactgacagaggaacatatgctggagaattatgcaaagttcgtgaaaatgcaggggatctatctgatcgtgacggtcggcttgtccgttctcggtatcgttcttttcattgtcctcatgacgctcggcatcgtggacgacgcgtttaataatattgatgccaatacatattaaaaaggaaaatcccggcgcatccgcccgggattttttcttattccgcttctccgacaacggtaaagtttttctgcttcggatttgccaatacggcgaacagcattgacgctgtatgcagatattctttcggcaaaaaagttttttcaaataaaacgtttcctcagagttttaactgaaatcactgagttctgcgaaataaggctatggcggtacaagaccactcatcatacaattttttgggtctttgtaattaaattacaattgttcttaatattcacccatgtattcatgctattatattgaaaggaacgatcaaaagcgttggcgttcgttaaatatttacgagtgctgcctcatgtcaaagtcagaaaaaatagtataggaggtaacatatgtttaagtttaaaaagaaattcttagtgggattaacggcagctttcatgagtatcagcatgttttcggcaaccgcctctgcagctggcacagattactggcaaaattggactgacggggcggaacagtaaacgcagtcaatggctctggcggaaattacagtgttaattggtctaataccgggaatttcgttgttggtaaaggctggactacaggctcgccatttagaacaataaactataatgccggtgtttgggcgccgaacggcaatggatatttgactttatatggctggacgagatcgcccctcatcgaatattatgtggtggattcatggggtacttacagacctaccggaacgtataaaggtaccgtaaagagtgatggaggtacatatgacatatatacaacgacacgttataacgcaccttccattgatggcgataacactacttttacgcagtactggagtgtccgccagtcgaagagaccgaccggaagcaacgctgcaatcactttcagcaatcatgttaacgcatggaagagccatggaatgaatctgggcagtaattgggcttatcaagtcttagcgacagaaggatataaaagcagcggaagttctaatgtaacagtgtggtaacagctcatctctaatgaggggcagctaacgggctgctgatcgttccttgagaaattttataatgattgtgaagaggcgaacggttttggcattaccggaggcaggatattctccatcagtttttttagcgcgtattaaaataagagttccgtctttttttggtaacccgcttacaacagacaccttcacataagccttaagcaaaataaaaatatcccggttaccacctcctttagtttcggaggttttcttcattaaacagatcgcaatcccgcatccaggcttgtctgaatatggagccaaaaccgtgatttcctcattacccattgtaaccatttccgttacacgtctagcggcatgaacccatctctttttaacaaaagagatgattcattacatcataaagggacttgctcgcaagttcattctccattgcccgctgtacgcttccgaacgtctcatcgagcgcgcgctgaatatttttgccgaccggacagtcgggattcggattgtcgtgaaccgcaaaaagctcttccttattctgcaccgccctgtaaacctctaagagggtgatctccgacggatcttttttcaggctggctcccggaacacccgcccgggatgtcagaatacccgcttttttcagctggctgatcgttctccgcactacgacgggattggtgtttacgctgcccgcaatcatgtccgatgacgcccgttcatccgttgagatcagcgataaaatgtgaatggccacagcaagacggctgttaatcatgtttttcaccaccattgtaaccaaaatagttacatttcatttgtttgtcaactactaatatacactaaaacgggcggcaggatgaaatcaagttggcaatagagggtaaacaggccggcgggaaaccggccggagagggattaaaataagaaataacgctgtcctagcggaacatagctgacgggctggcatgccagctcttctccgtcggcgaacacctgataggttttcggatcgacatgtatattcggcatcgcgtcattcagcttcatgtcgagcttactcagcttacggatattccgtacgggagaaatcattttttcaaggccgagcttttccggcacaccgtttgcgataccggcctgggacataaatgtaatagaggtattgcggtttgctttaccgtatgatgcgtacatctgccgcataaacacgggctcaggcgtcggaatggaagcattcggatctcccatctgggcgcgggcaatcatgccgcctttgagcacaagttcaggtttgacgccgaagaaaaccgggtcccatagtacgaggtcggcgagctttcctttttcaacggaaccgacttcatggctcagaccgtgagtgacagccgggttgatcgtgtatttggcgatatagcgtttggcgcgcacattgtcattgctgttttctcccgatagagcgccgcgctgttttttcattttatcggccacctgccatgtccggataatcacttctcccaccctgcccatcgcctgcgagtcagatgacgtcatgctgatcgcgccgatatcgtgcagaatatcctccgccgcaatggtggccgctctgatgcgtgaatgactgaacgccacgtcttcaggcacttttgaatctaaatgatggcagaccatcatcatatcaagatgctcgtccatcgtgttgacggtatatggaatcgtcggcgtcgtagaggacggcaggatattggcgtaagatgcgagtttcataatatccggtgcatggcctccgccggctccctctatgtgatatgtatggataacccggtcgccgatcgcatcaagcgtattttctaaaaagcccgcttcatttatcgtgtctgtgtggatcgccacctgaatgtccgcctcatccgctgcttccatgcaagctttaatggcgcttggcgttgatccccaatcttcatgcagcttcaggccgattgcgcctgcttccacctgctcgatcagcggcgctttatcggatgcatttccttttcctaagaaaccgacattgatcggaaactcctcggccgcttccagcattctcgacatgtaccatacaccggatgtacaagtcgtcgctttacttcccgtcgcaggacctgttccgccgccgagaagcgtagtcacgcctgaagaaagcgcgacttccatctgctgcgggcagataaagtggatatgcgtatccaccccgccggccgttacgattttcccttcgccggaaatgacttctgttccggcaccgataatcatgtgcgggtccaccccatccatcatatcagggttgccgcttttcccgacgccgacaatccggccgtccttcaccccgatatccgccttgacgattccggtataatccaggatgacggcgtttgtaatgaccagatcaagcgctccgtctttcccggtgatacgcccgttctgccccatgccgtcccggattgttttccctccgccgaaaatcatttcttccccgtaattcgtgaaatctttttcgacttcaatccataaatccgtatctccgagtctgactttgtctcccgttgtcggtccgaacagttctgcgtattgctcacgtgacattttcatcggatcgcctcctccatccatccggcttttttaagatttgacagcgtcttctcttttccccgctcatccatatacgtatcggccatgccgttgaggcctctgaccgtttttcgccctccgatttccacgagcgtgacggttttctcttctcccggttcaaaacggacagatgtgcctgacgggatatcaaggcgcatgccgatggctttgtcccgattgaaggaaagggcgccgttggcttcggcaaaatgaaaatgcgatccgacctgcactgaccgtgttccgttattggtgactgacacctccagcgtcttccggccttcgttaatggtgatggtccctttgcgacttgaatcgctcccggcttcatgacttcacctccgctttgatcggctgatgaacggtgacaagcttaaccccgtccgggaacgtcgcttccacctgaatgctgtccagcatttccgcaacgccttccataacgtctttttccgtcaatacattgcggccggattccatcagctcagcaacgctttttccgtctctcgcgccttccatcagataacaggtcaaatatgcggcggcttcgggataattcagcagaacgccgcgcgccttccgctgcttagcgagctctcccgccgtaaaaataagcaatttttcttgttcaaccggtgtcagtttcatctgtattcccccttagtgatagtcaaacacaatccgcatggtcataccgaaacgatgcaggcggccgtcacccccttcacctcatgaaatgttaagtgataaaagttattcgacagtgaacggcccgattccttttgcagaaatgaccgatttctcatttttttcttcaacaaacgtttaattaaatgtgaagaaaggttacattctttgtgaatattataaagaaatcgccggggaatttatagaatatttaaaaatttagtgaatattaaccaaacgaactggaatttttgtcatttctcataacaaaaagcccaaaatattttgggcttttgctgtgtttcacgatcaaattaatcatcactgagtttatctttcgttttaccgacacccttttgcaggctgcctttcgctttgtcttttttcccttccgcttttaagtcggacttgtttgccatgtcgcctgctttgtcctttgcttccccttttattttgttcatgccgccttttactttgtcttttaaaccgttatcttcactcatgatctcttcagctccttttgtttttgtgtacttgttttcttccctttcagcctgatagcaaacatttcaactctcaattattgatttcacagcgttccccgtagcggatcactttgtaaacggccaatccgtctgacagcttattatccccgtattgcacgggcagaagagcaaagaaaacataataagttgaaaaatagacaaattggtaaaaaaataagtttggctctaggaaatcttttatgatcagcagatttattaaaaagatagaagcgagattaaacagacagcctccggaatagacgagcgcgctcgtcagacggttatctatccgcaattcgccgaacttgcagaaagaatctatgaagtagatacgccgaacctgaatcggccctacttttaaaagacgtttccccattccgatatccaacgacgccttgcctccgaacagcatggccataaagctgtgtcccgacacatggatgacagacaccatcgggagaatgatgagaaatgaaacgaaaaactttatcatatcattaaatccgaacaacaaatccctccttcccatcgtacttttttccctcttttgcgatttttccgattttttctatgatcaaacgtcctgatgtgcataaaaaaataaccatctgctgatcagatggttaacaaaaattatatatcgtataaacactgttctttttgaattttttctctcatgcgaatcgctttttcataaaaatacgccgcttctttatattgctcatgtgcgcttgtgtaaacggcggcctccaaggcgaaatcttcaatatacacatacagcgatttttcattcatatagtcaaacacttcatggattaaatccatattgagtgactccaaataaagcgcttgtaaaaacttatacttctctaaactgaatcggtcgccgcgttctttcgcgatcatgatccctctttcataataggtaagggccgcttggtcatcatgcagcctgaaaagggtgtgcgttaagctgaacagcgccttcggaagctgttcaagctgatgctcttcaaaaacgggaaccgcttttctaaagtaccgggccgcttcatccagatcccgcttttcagcataacaattccccagattgtaaagcgaagacccgatcaggcggggctgtccttcaagcaaagaaaggcggagggcttcgtctaaatgctcaagcgctttgtcgtagtttttgcagtcgatgtagtttcctgaaatgacgaaatggcattgaattctccgcactctgtaaaaatcgtgtttcatatacgtatccagcgcctgaatcccgtgattcatggaaaaatgagtctgcttcatgacgtaaaaaacttcagacatcttgaaatggaattccgccctctctatatcatcctcgacaaatgaaaggagtttttccgctttccggtaaaaagaaatagccgcaacatagttattgtgatcgaattcatacatccctctgaacaaatggaaataatactcagacagtcccgatatgctgtccgtgctttcgatcgtcttttgcagctcgctgtactgaatctgtgattgttcggtgcattccggcttgacgtaatcaagcataatatgatggcggtagctgatcagctgataatataacagcagcagctggtcttcctccatacgttgtatatcctcatcaatttcctctttcagctttatggcatcagccgcttgaaacgctaaaatgtgcttgtaccatttgttgatcttgactccaacttgagatgacggaatctcgtatgcggtcatgcccctttcacaaccttttctaatttctattggttatattttaacatattgtatggctttggaattgcataacttgattgtcctgcatcaaaattcctatcatatatttcggctgttaccggtattttttgaacagaccgctctcatattgtgaataaaaaagcctgcccttgtccgggcaagcttttcttcatccgcctatataagacatttccactttctttttcccatccgttttagaaagcgcgcggtcaattgaatactgatccgcgcgatttctccagacagaagcgatggattccgtcaattcatcatcggtcagaccgccgcgcacgagtttccgaacatcatagccgcttgacgcaaacaggcacgtaaacagctcgcctctcgccgacaggcgcgctctgttgcaggaggcgcagaatgcatccgagacggaggaaatcacgccgatttcgccggaaccgtcaagatagcggaacctggaagcgacctctcctttgtaattcgcttctatcggctccgtcggcatgtgctggttgatcagatcaataatttcggccttcgtgatcacgtcttttttattccattgattcgtattgcctacatccataaattcaataaaccggagaatatgacctttttctttaaaatagcgggccatcggcaggatatctttttcattgacgcccttttgaacaaccatattgattttcacaccgagtccggccgcttttgccgcctcaatgccctcaagcaccttgttcaccgaaacgccgcggccgttaatggccttaaaccgctcatcctctaaagaatcgaggctgactgtcactcgatgcagccccgcctgcttcagtttttccgcatacacgggaagcagagagccgtttgtcgtcatcgcgatatctttaagtcctgggatgcgcgcaagttttttgatcaattcaggcatatcttttctcatgagcggctctccgcccgtcagcctgattttttcaacgccgaagcggccgacaaacagcttcgcaagccgctcaagctcctcgaaggagagcaattccgtcttttgtaaaaatggataatccggtccgaataattcggctggcatacagtacgtgcatctgaagttgcagcggtcggttacagagatacgaagatccctgagcggcctttcctttttgtctgtcacccggcgcgtttctgtattcataagcccaagacccctttctattgttcaacccgttcaggatgtgtgtatacgttaaatgatccgtttctgacaaaaccgatcgcggtgatgttcagctcttccgccatttgcagcgcgagctccgtcggcgccgattttgaaatgacaatcgacacgccgatttttgcggcttttaataaaacctctgaggaaatccggccgctgaagacgatcagcttgtcacggacgggcattccgtttttcaaacagcagccgtacagcttatccagcgcgttgtggcgcccgatatccgtcctcatcaagagcagcttttccgtatcgcacagcgctgcattatggacgccgcccgtttcccggaaggtgccgcttccgctttgcatctccttcatcaggcgaaggcacgtctcaggagttatggtaatccggctgacggcggttttggccgttttcacatcctgctgaaagtaaaaatggcggcctttcccgcagcatgaaccgatgaccctcttcgtatagtctttttgctcaagcactccgggattcgtcagttcaacatatgcgaacccgagactttcatctatagtaaagcttttgatctctttttcaaaacgaatgacgccttctgatgcgagaaatccgatgacgagttcctctaaatggtcaggcgtgcagacgagcgtaacaaattcctgcccgttcaccatgacggtaagcggatactctgaaaccatccgatctgccgtctttgttaatacccctttttcatagcggtatatgtctcttaccgctgttgttttttcatccactgttttcccctccgcagtatccttctcttttattcttccacaatccctgtattttgtcgaatttgcggtttaaaaaaagagccctcttcggactctatgtttcattgcgatgatgtctgctcagaatggtgaataaaataactgcggcgataatggccaatatactgacgaatatgaaggcggcaagcttcagaaaaatccctatcagaacaaaaacgactgccgccagcaccaatataatgcctgctccttttaacaacagcgttcatctccttttatccgtatcattcccgcggttccgttttctaaacaaaaaaagacgccgcacgggcgtccttttttaacctattcttttgctaaatcctttgcggcgtcttcccaagcctgtttgaactcgtccgcgctgtcagctgagacgtatgtgccgcctcccgcttccgccgctttttcaaggctttcgcttcctttcatgccgaagttgaagccgatgatattgacgaccgtgttgacattcgctttacggagcttttgaatttcggcttgaggattcccgccgcatgtttcttcaccgtctgtgatcagatatacgacgtttttccctttagcgccggcccgctcaaattcttcacgtgtatcagaaagcgctttcgctatcggtgtccagccggtcggtttaatcttgctgagtgattgctcaaatggagtcacggcgtacggctgaaggccgtataacgtttctgtcgcgttacatgatacggctttgcctgagtttttattattgcccttatgcccgaatacccgaagcatcagattcgtgtcttcaggaagaacttccgcaaaagaagtgacagactctttcgcaacatctattttacgctctccccctgttttttgtatcatgctcccgcttgcgtcaaacagcacggcgacgtttgtttcttcgtgctttttctcagctgcaaaaacaggtgatccgagtgaaagcgtcaaaagtccgacaatccccgcagtgaacatttttttcatttccttcattcctctccgtttgtttttggccgatgggcccccggctcttctctatgctagatgaggagtatgcaaaaagatatagggcgggattccttttgtataagcggctgtacgccgttaaaaatgaacagaattatgcgcatcatcctaaaaagattggataaatgatgacagatttaatgcctttttcgccctttttgtaatataagtccggaatctgattctttttacagttttctcttcatcttttcttgaaatttttgttaaataaaaataaaaaaaagggccgctaaacggcaccttttcttatttcgctaatgaactcgcttccatcgtaaagatgcggttcatatccttttggctgtgagcttcgtaatattttcctccgcccgcaccggcaattgcgtgaagctgtccgttgaagccttctttaaagtcaaagccgatcacgttgactttaatatgatgtttgcgaagttctttcgctgtcttaataggatctccgccgcatgtctcctcaccgtccgtcaacaggtaaacggatttaaagccgaatttatgaacgccgttaaaagaagccttcgcatcttctaatgcttttgcaatcggtgtccagcccgtaggcccgattccgttcagagagttgaggaagctctgtctgtcaaacttttggaatccgtatacaccgcgaatggattcacaagattgaacttttccggagtttttattattgccttccgaaccgaaaaccgtcattctgacctgtgatgtagacttaattcgatctgcaaaacggacgatttcatcttttgccatattgtatttagaaacgccgtcaatccgtttcgccatactgccgctcgcatcaagcagaatggcgatattgtttttaaataaaaatgtcttctcgtttgcattctcggcagcaaaagcaggagatgcagcagtcagcatcaatccgagcatgattatgagtgaaagtgtttttttcattgcttcttccccttttcaatagatttacgttcaacgccgaacaatatttatcgtaaatgagatgaaaagggaaataaataggacggcgttcctcattatttttgcgtatattcacatagatacggcatttttatcagtgattttcacccggcgctcagccttcagacggcatttgtcagcctttaggctttcgttatatgagtctgttggttgctttaccgtttatggaatagttttcaaaaaaaacagacgctcatgaaagcgcctattttttcgccatatatttgtttaaaaatgaatctgcttcggatatgtccactccctgataataatgcttgacgatgtccgccacggatttcccctgctccgccatgtaattggccccgtactggctcatgccgacgccgtggccgaatccttttgtcgtaatggtgatgctgccgccgttccgtttccattcaaagtcggcagaacggagtccgagtttttcccggatgtctcttcccttcagctttttgccgtttatgacggccgtcgccacttgatggcccggcgttctggctgtaatctgccctaccgtgttttgtcccgagagctgtacgccgagcttttgctgaaactccggcacactgaaggtctgggtggcaagatatttcggcgattgcttatcccacggacttttcacgctctttaaataaggaatggcgcttgtccaataggcttccgcattttccgtatacccgttgctcgtagagaagaaagatgcctcaatcggcttgttgtcgtacgttaaaatctttccttgcgtgcctgcgaccgcgtttgtgattttcttgaggttgtgtgcgtacttagaaccccattcttttttcagctggcttttgctttgatagacttggaacatttgcgtatcgtccaccagtgatcctttcggcgcctgaacggctgagtcagcaaccatcaatctgacgatgaatgtccgggcggcgagcgcctgggcttttaaggcttccggtttaaaggttgcgggcatttcggaagccacgacaccgatcacgtactcttcaagcggaatgttctctacagaatgattggatgtccgataaaccggaatggatacaggtgattctttcaatgtttctgctccttttgtttctcgtgtggtgtgtgttgttttgtgtccgggctctctgtttacggctgctcctttttccgcctgaaacggaagaacgagaatggtgggaacaagaagaataagtatacacagcccggatagtagaaatacaatcggtttcatatatcagctgcctcctgcttgggattcgactctacttcatcttatgggcagggacaagctaatatgacttccttttggacagaatcttattccatttttcacgcgaaaaacgtattcttttttgaaaatcagagcataataatgatgataaaccataaaaaaacagtatgccagattgacatactgtttttacagccattatgcgtttaggtcagttacgacttctttgctttcttgttcagcggccgtttcatcaacgacacgctcgatgtcagcgccgagagccgcaagttttttatggaaattcacataaccgcgatccaagtgcttcagttccgtgacgcgtgtatgaccttcagccactaatcccgcaagaatcagcgccgcgcccgcacgcaggtccgtagcggcaacttctgcgccttgcagctgtacaggaccgttaatgatcacagaacgtccttcaattttaatgtcgccattcatccggcggaattcttcagcatgcataaaacggttttcaaacacagtttcagtaatcatgcttgttccgctcgcacggagaagcagcgccatcatttgcgactgcatatcagtcgggaatcctgggtgaggcatcgttttaatgtcgatcggcttcagctgggcaggaccgatgacacgaaggccttctccttcatccgtaattttgactcccatttcttccattttcgcaattaaagacgtaagatgctcaggaaccgcacctttgactaatacatttccttccgtgatagccgcagccaccatgaaagtacccgcttcaatacggtcaggaatgatgttgtgtcttacgccgcgaagcttctcgacaccttcaattttaatggtgcctgtgccggctccgcggatttttccgcccatcgcattgatatagttcgctaagtcaacgatttcaggctcttttgccacgttttcaagcgttgttgttccttcagctaaagcagctgccataatcaagttttctgtcgcacccacacttgggaaatctaaatagatttttgcgccctgcagacggccttccacttctgcttcaataaagccgttgcctactttgatttttgcacccattgcttcaaagccttttaaatgctgatcaatcggtcttgagccgattgcgcaaccgcccggaagcgctactcttgaatgacccgtacgagctaacagagggcccataacaagcactgacgcgcgcattttgcgcacatattcaaaaggtgcttctgtttctaaagcgtaagaagcgtttacggtaacttcattattctcaaaatgcacatctgctcctaaatgacgcaacacttcattaattgtatatacatcggagagcgtaggtacatcacatattacgcttttttcttcacttgctaataaagatgcagcgataactggtaaaacggcattttttgctccttcaactttcactgtgccgtttaacttctgaccgccgcggacgatgattttttccaaggtattcccctccgcgtccctatattctctatattaatattcagttgtcacgattggtgtgccaaccgtaacggtatgttttccgcccattcccgcacttctaagcgcaacttgcacattcatcttatgtttcgatgtcatgatgtaatctgtccacttatatgtaaatgcagaaacagaaacgaaatgaggctcaactacatgttcaactggacttgcttcaaattctttcatgagctgttctgcttttttttgcaaaacaatactcatattatcatttaaatgaccctttagacaagtaaaaataaatactttattttgaaatatgtcatgtgcctgccgttcaaactgttcatatgtatcattccagttttccggttgctccgggctcatttgctcatataataaatacgaagttgggttctggtttttgagggtagtgacgagctgcagtttaaaagttgtgtgattttttttgtcagaatacgtgccgacggcctttacgattttatcttcccgcgcggattcccaatgatattgcggatactgcgtcttcagttcttttaccttgtcatcaaattcactcagtgacaggttcagattttttttcgcatgaagcgtccattcatccacagtgacctgctgccgctccattccttcggcaatctgggcaagcggagacagctcacttgcatgaatggaatgaaataccgctattaaggcgcttaaaaaaacaaaaaacaagatgatacggcctgctctttttttcttcatatcgatctctcccccttactcccatttttgccggagccggggaaagcaatacatggaaaacttcgtcaaaactcgccaagcgggtgaagaaaaattggtttctcacccagcgattcccttcatttcaacagacgaaacatcttaaaataagtatggaagctgtttcgaataggtaagataatctaaaaagaagttggcgactgccgtaccgatcgcaatggtaagaagaatgatcagcagcctcgcctgcactatttttccttttcggatcagcggatcaaagttgacggcctgaagcgcccaccatgtcaccgcaatgcataccaggtgaaccaggatgctgattgcggcctgctgccccaatacattcacaaattccatctcctttcattttttccgcccctcatatcctctcttattatataagaagaagagagaaagatgatcatttttacatcagaatttttatccaaaattaggggcaatccccgcttaaatgtccgttctccggcatgatatacttttttggaaaggagatgggaatatgaatcattccttttttcatccggaaaagcagtatggagaaacacttcccgtatttgaccacgagtgggaagcgatagcattctactatgattatagacagtctcaaacagaggaactgaaagaattatgtcagtttttcaacatttctcttgattattcacccggcagcctgctggcagtggaagctctttacttccgcagcataaaagagctgcttttggcggattggaacctgccgattgacgaatttgagaaaatgctcagtgtgtatgtcatcgattgcgccatcagacatcatgacgatgccgaatgggtcgtcaaaccttatccgtatacggacggcgcttatacgacgggtgtgcggagaggaaacaaaacgtggcacaccgacaactgctgcgaacatttatatctgcaaaaagaagaggatcatccgcttatcggcgtctatgaatctcttatgcgttaatatagaaaaagaatccttctcagacagccgagaaggattcttttttagtttcctgcaacatccaatctgtttacagcccgctgtaacgcaagctcagcccgacgaatgtcagtatcatctgatcgtttgttcaaacggtcttccgcccgctttttcgcagcaagggcgcgctctttatcaatgctttccgctgtttcagcggcttgtgcaaggatagtgacctgatcaggacggacttctaaaaatccgccgctgacagccgccaattcggtctgcccgtcttttttaaggcggacagcgccgattttaagcggagccacggtcggaatatggccaggcaggataccgagatcaccgctctcggctcttacactcaccatttcaatatcagcatcatatactgggccgtcgggagtaacgatattgactttaacggtcttcatgcttttaccctcctaggaccagattaaacttctacacccatctcttttgcattctcaatgacttcttcaatgcgtcccacaagacggaatgcatcttccggaagatggtcatatttaccggaaaggatttctttaaagcctcgtaccgtttctttaacaggcacgtaagaacccttttgtcccgtaaactgctcagctacgtggaagttttgagaaaggaagaactggatacggcgtgcgcggtgaacgacaagcttgtcttcttcacctaattcgtccataccgagaatcgcgataatatcctgaagttctttgtaacgctgaagcgttgactgaacttcacgcgccaccgcataatgctcttctccgacaatttccggagcaagcgcgcgggaagtggaagccagcggatcaaccgcagggtagatacccatttcagttaatttacgctcaaggttagtcgttgcatccaagtgagcgaacgttgtcgccggagccgggtcagtgtagtcatcggcaggcacgtagatcgcctggatagatgtaactgaaccaacgtttgtagacgtaatacgctcttgaagctgacccatttctgtcgcaagcgtcggctgataaccaaccgcagaaggcatacggccgagaagcgcggaaacctctgaacccgcttgtgtgaaacggaaaatgttatcgataaagaacagtacgtcctgtccttgtttatcacggaaatgctcagccattgtaagacccgtcagtgctacacgcatacgtgcgcccggcggctcgttcatctgtccgaagaccatggctgttttcttgataacgcctgaatcgctcatttcgtagaaaaggtcgttcccttcacgagtacgctctcctacaccggcgaatacggaaataccgccgtgctcttgcgcgatgttgttgattaattcctggattaatacggttttacctacgccggcgccgccgaacaatccgattttaccgcccttgatgtaaggagcgagcaggtcaacaaccttaatccccgtttcaagaatttcaacctcagttgaaagctcatcgaatgaaggagctgatctgtggatcgggtccttttgagcatccgcaggcagcggttcatttaaatcaattttatctcccagtacgttaaatacgcgtccgagagtcacatcaccgactggaacggaaatcggcgcacctgtatcaacggcttccattccgcgctgaattccgtccgtagatgccatggcaattgtacggactgtatcatcgcctaaatgaagagcaacctctagcgttaggtcgatgcctacttcattttcgcctgtagctggctgtgaaactttaatcgcattataaatcgcaggcaagtggccgtcctcgaaacgtacgtcgacaaccggtccaagcacctgacttacgcgtcctttcttcatcgctatccctcctgacaaaatctttctattctaaagcggctgcaccgccgacaatttcggtaatttcttgtgtaatcgccgcttgacgcgcgcggttatatgaaagcgaaagtgaatcaatgagttctttcgcattatcagtcgcatttttcattgctgtcattctcgcagcgtgttcacttgctttactgtcaagaagcgcgccgtaaattaagctttccgcatattgaggaagcagcacttcgagcacctcttcttcatccggttcgaactcgtaagaagccgtgcgcttcccgccgctcgttccgaaatccgttaaaggcagcacttttttctccgtcacttcctgtgaaatcgcactgacgaaatggttatacaccaaatgcagttcatcaaaagcgccgtcgataaacatttgaaccgtctgacgggtcaaatctttaatctgagcaaaagtgacctcgtcgccaagccccactaactcagacaaaatcggcatctcccgttttttgaagaaatcgcggccgactctgccgattgcaatcaccgtgtattcatctttagactgatggcgttcttgaatggtgcggtaagcgtttcgcaaaaccgaactgttaaacgcacccgcaagcccgcggtcagacgtaatgacgagatacgccgtctttttcacttctcttgagacaagcatcgggtgtttcgcgtttttcgcgccttttccgacgttaaacacaacctcctggatcttatccatatacggagcaaatgacttcgcgttggtttccgcacggttcagcttcgcagcggataccatctgcatggcttttgtaatctggcttgtttttttcgttgacgtgatccttgacttaatatcgcgtaatgaggccaaagatttcaccacctttattcttcatttgcgtaaaaagagagaaaaagagaacctttttctctcatcttctaagggttagttgcttggtgcaaatgtgcgtttgaagccttcgattgcagctttgaagtcttcatcagcaggaaggtttcctgttttcgcaatgccgtcaagcagatctttatggttttgatcaaggtacatgtagtactcttcttcaaaacgtctgatatccgcaaccggaatatcatcaagatatccttttgtcagcgcataaagaatggctacctgtttttcaaccggaagcggcttattcaagtcttgcttcagcacttcaactgtacgcgcaccgcggttcaatttcgcctgagtcgcctggtcaagatcagatccgaattgggcgaatgcttcaagttcacggtatgaagcaaggtcaagacgcaatgttccagctacctttttcatcgctttgatttgggctgacccgccgacacgggatacggataatccggcattgatcgcaggacgcacgcctgagaagaatagatcggattgaaggaaaatctgtccgtcagtaatggaaatgacgtttgtcgggatataagcggagatatctcctgcttgtgtttcgacgaacggcagcgccgtaattgatcctgcgcctttagcgtcactcagcttggctgcgcgctcaagcagacgggagtgaagatagaatacatccccagggaatgcttcacggcccggcggacggcgaagaagcaatgacagctcacggtaagcggccgcttgtttggataaatcatcatatacgacgagaacgtgcttgccgttgtacatgaattcttcacccattgtcacccctgcatacggtgcaaggtaaagaagcggagccggctgtgaagcggatgccgtcacgacaatcgtgtaatcaagcgcgccgtgcttacgaagtgtttccaccacgccgcgtactgtagattctttttggccgatcgctacgtacacacagatcatgtcttgatctttttggtttaagattgtatcaatcgcaacagatgttttacctgtctgacgatccccgataatcagttcacgctgtccgcggccgatcggaattaacgcgtcgatcgctttgatacccgtttgcagcggctcatgtaccgatttacggtccattacgcctggagcctggctttcgatcggacgtgttttgcttgtcagaatcggacccagtccgtctaccggctgtccgagcgggttgacgatacgtccgattaattcttcacctacaggaacttccatgatgcggcccgttcttttgacctcatcaccttcgcggatatctctgtaaggtcctaagataacgatacctacgttggattcttcaaggttttgagccatacccaaaacgccgtttgaaaactcaacaagttcaccggccatacaattgtcaaggccgtgtacacgcgcaataccgtctccgacttggatgactgtacctacgtcatgaacttcaatttcagattggtaattttgaatttgctgctttatcagcgtgctaatctcttcagctttgatgctcacttaggtttcaccccttctatcgatttcctccggcaagttgacgttccatgcgctcaagctttccgcttacgcttccgtcataaatccggtttccaatgcggactttaatgccgcctattaaatccgtctgcacttcatttctgattctgagcgaagcgattccggctttttttgcaaacacttgagacaatgataacatttccgcttctgaaagcggctttactgaataaacaaccgcgtcctctgtctgacgggcctgattggcaagtttgataaactcgtctgtgagatcaggcacaatcgaagaccggcggcggtcaatcagaagaaaaatcgtatgcagcacagactcagacagtgcgccgaacgattgctgaatcagctcttttttcttagcggccgataccttcggatggcttagcacttcctgtaatccggcttcgtttcggaacacttcttttagtacggtaagctcttcttcgatttcattgatttgagaagtctcaacggcaatgtcgaaaagcgctgacgcgtatcgtttagagacagcagatccactcatcggctttctcctacctctttaagatagtcctgaatcagttgttcctgggcttgttcatcaagctctttttcaatcactttcgatgcgattaagacagaaagtgatgcgacttgctcgcgaagtgcggaaaccgcttgttctttttctttgacaatttcggttctcgccgcttctttcaatctttcagactcggcgcgtgcagcctggataatgtcttccttctgcttttcacccagttttttcgcattttcaatgagtgattgtgattcctgtttcgcttcttttaaaagaacgcgctgctcttcaatcagcttctgcgcttctttatttctttcttcagcggacgtaatttcgccggcgatatgatcttcacgctgtttcattatatttaatagcggtcccagagcgaatttcttgagaagcgctaataaaactaacatagctaacaattggaataggatatctccgccgttaaacgacagtcctaattcaagaggtaattgagacatctactacggcaactcccttctgcaggttttctctgctgataaaaagccgtttcgggacggcctgcttatcagacataaagcaatggcgaaggttctcttagagtgatcttcgccatttttagttcatataaggcttttttgcttagccaaagaacgctaagaacgcgataacgacagcgataatcggaagggcctcaaccaatgcgatacccatgaacataagagttctaagttcttttcctgcttccggctgacgggcgattccctctaccgtacgtgaaacgatcagaccgttaccaatacctgcaccaagtgcacctaaaccgattgcaattgcagctgctattaaattcatgaaaaagttcctcctttaaaatgttatccgaatggatatatgattttaatgatcatgactgattttgtgtgacatgtacaccatcgtcagcatcgtaaagataaatgcctggatggtaccgatgaacaagctgaatgcctgccatgcaagcatcggaataatggctccgactgtgccgaccaaaccgagaaagaaactgtttgagtagaaattcgtcgccagattcgcaagcaggccaagaagaatttccccggcgaaaatgttaccgtaaagacgaagtccgagtgtcagcgtattcgcaaactcctcaatgatcttcatcgggaacataagcggaaccggtctgaggtaatccttagagtattccttcaaacctttcatcttcacgccgtaatagtgcgttaacgacacaaccataacggctagagtcagagtaatagccggatcagccgtcggtgatttccaccaaagctcgtgtccgaccgttacagaaaacggcagccctagcatatttgatacaaatatgtacatcagcaaggttacaccaagcgccaagaagttagcccctgtttttaaatccattgtactgcctataatattgcggacaaaatcaacaatccattccatgaagttctgggcttttcccggacggatggacagcgttcttgtagtaagaatcgcaatcagcagcacaatcacacttgccacagtaatcatcagaatgtttgtcagattaaaagtaagaccaaacaaatcaatagttctgtaatcgtgattcaatgggttttcacctctcttccattgatgaacgtttgagctgaataatggaatctatcataatgacgggataaattgtcattaatccaataatcacacttgccacactgactttatcgggatatttaaaggcgacagccatcgcaagtatcgcattgcaccaacgcgctgcgctcccgagtgatcgtatggactttcctttcgccacggccttgtcaaaagcattcattcttctggtcaagagccacaaattaaacaaactgaaaacagttcccaaaaagaggcctaaaaaaacagttttatacgccgtaagaccatatcccagcaaatagattgctaagattacaaatacatatctccgttgtctgctgaatgtaagattgggatcgtccatcaactatctgtctcctgatgaaaatgtaatataattcctggatacggcaaaacatgcggttaacccttgcagaaggccttttttgtccgcaaaacggcctgttcgaaaaaaccactcatcctcctgatgctacgggatgctgtttcattcgcttagataaatcctcatataacgggtttttttggaggatttaaaatgaggatggatactagaaatgaaaggaatgaaaaccttctcataataccctcgtttagcatacaatagccctaacatgtgtcaatctgtttaaagttaaaaaactttttataccggaagcatacacagaatgttcacaaattcacctataaatgtatgacctctgcccattcagctaaaatctggataaaaaaaagaaaacccctgaatgaggttttccgatttatttggttccgtacagtctgtcacccgcgtcaccgaggcccggaacgatatagcctttttcattcagtttttcatcaagggcggcgatataaatatcaacgtcagaatgatgtttctgcagctcttccacgccttccggagccgctacaagacacataaaacgaatgtttctcgcgccgcgctttttcaggctgttgatcgcttccaccgcagagcctcccgtagcaagcatcggatccacgacaataaattcgcgttcttctacatcagaaggaagcttgacatagtattccaccggttttaaggtttccggatcacggtataatccgacatgtcccactttagcggccgggattaatttcagcatgccgtcaaccattccgagacccgctctcaggatcggcacgataccgagtttcttccctgaaatcactttggatgtcgctgtttgaacaggtgttttcacttccacttctttaagaggaagatcacgtgtaatttcaaacgccatcagtgatgcgacttcatccacaaggtctctgaaatcctttgtgcctgtattttcattccgaatatatgtcagcttatgctggattaaaggatgatcaaatacgtaaacctttcccatactgtgttcagctccttttttgttgtccgagtgactttttcacacttctattgattctacagaaaaagacaaacagtttcaagaaaatcataaaaaaacccgccggattaaggttccggcgggtttcttccttattaatagtccagttctttatataaaggaaacttttcagtcaaggcagatacgcgctgtttcgcttcttcaagttttgcttcgtcttcatgatttttcagcgcgaggccgatgatggcgccgacttcttcaagcgcgtcaccgtcaaagccgcggcttgtcacagccgccgtaccgagacggattccgcttgtgacgaacggtttttccggatcgtaagggatcgcgtttttattagatgtaatgccgatttcatcaagaacgtgttcagcgacttttccggtcagtccgagagaacggaggtcgacaagcacaaggtggttatccgttccgcctgatacgagctgaataccctctttgttcagagactcagccaggcgcttcgcgttcgagatgacgttttgcgcatatgttttgaaatcatcttcaagcacttctccgaaagaaacggcttttgccgcgatgacatgcataagcggtccgccttggattcccgggaaaatggatttatcaatcttcttgccgaactcttcacggcaaaggatcattcctccgcggggtccgcgaagtgttttgtgagtcgttgtcgttacaaagtcagcgtaaggaaccggattcggatgaaggccggctgcgacaagacccgcgatatgcgccatgtctaccatgaagtaagcgccgacttcatcagcgatttcacggaattttttaaagtcgatcgtgcgggggtatgcgctcgctccggcaacgatgagtttcggcttatgcgccagcgctttttcacgcacatcttcataatctatatattgcgtgtctttatcgacaccgtattctacaaagttgtattgaacgccgctgaaattaaccgggcttccgtgtgttaagtggccgccgtgggagaggttcatcccgagcaccgtgtcgccgtgctctaaaatcgtgaagtaaacagccatgttcgcctgagcgcctgagtgcggctgaacgtttacatgctcagctccgaaaatctctttcgcgcggtcgcgggcgatgtcctcaacgacatcaacatgctcacagccgccgtagtagcgtttgccggggtagccttcagcatatttgtttgttaaaacagagccttgtgcttccattaccgcttccgtcacgaagttttcagaagcaattaattcgatcttagtctgttgacgcttacgctcatctttgatggcgttaaacacttgtttatcttgtacaggtaaatgtttcatcagcgagatcctctcctatccgtttcctgttctttatttttaccaccttattgtacatggtttttcaggtgaatgtaacagcttatttaaaaaaatcacaaaatttaattagaaaacacgaacattatagaggaaaagtattttcatcattcgcattcatatacggcgcgaattccgcctatcagcttcggtcttgtccgggccatcgtcacatgtgcttctccaagctcacggctcgatatccggacagggacggcaacgggtttcagatgcatgccgatgaacgtatcaccgatgtcaatcccggcgtcagcctgaatcgattcagcgagcactggagaacgcatctgccggtatgcataagaggccatcgctccgcccgctttcgggacggggacggctgaaacaatggggagcctgaaccgctcggccgtttccgcttcaatgacaagcgccctgtttaaatgctcgcagcattgaaaagcaagatgcacacccgttttttccttaaaccggttaagtccgccgtatatcaattcagcccaatccccgcttccggcggtgccgatccggcttccggcggcttcacttgtactgcacccgaccaccagcagactgccgtccgtcagtcctgcctgctcttgaaactcagtcagcatgtccgtccatttttgcttcatctcttccattgtccagcacctcttacagatttttttcttcgtaatctgcgattttgccgatccgccgttcgtggcggccgcccgtaaattcagtcgtcagccagacttttgcgatttcgcgcgccagccccgggccgatgacgcgttcgcccatcgcaagaacattcgtgtcattgtgttcacgcgtcgcttttgcgctgaaggtgtcatgggcaagcgcacagcgtatgccctttaccttatttgcggagatgctcatgccgatgcctgtgccgcaaattaaaattcccctgtcagcttcgccgttcaccactttttccgctaccggaaaagcgtagtctgaataatcgacagagccggcgccgcattcacagcccatatcaatgtattcaatctgcaattcatccaaaagactttttatttcttcgcggatatggacgccgccgtgatctgacgcaatagctactttcattcatttacctcctaggtgtggctgggcgaagacagcccagtgtgcttgtcctttttattacgaaatccgttgatttcattctactctttcacattcgttttgcaaatgacctgtttgcagattttctgacagattacttgcttttcccgtcaagcaattgatcagccaaaagggtcagcagctcctccagttcgtcccgcgtctgtttataaacatcaagcggaccgccgaacgggtcagagatatcgccgctttcccccgtcacgtattctttaatggtaaaaactttgccctgactgttttgatatcggccttcaatcagctgtttatgctgttcggtcatcgccagcaccagatcggccgtctcgatatgttcttccgataagggagatgaactgtgattgagggcgatccgtttttcaaacagcgcttctacggcatgagccgacgcttttccgtgcggagacgcgaatacgccggccgagcttacgctgacatccagccctttcgtttctgctatggatttaaaaagagcctcagccatgggactgcggcacgtattgcctgtacaaacaaagattattttcatgtccgtcacctcttactacctattataaatgaagaaaaaagaaacggcatcttcgtttctttttttacgtatcttatatcggtaaaagcagtttcagcccgaatccgatcaaaatggctccgccaagcgcttcgctgtaggagccgagccatgactgcacctttcttcccgccaaaaggcccgcccatgttaaaacggtgctgaagaccccgaacagcgtaacggccagaaacggattggagccgttcatcccgagactgagcccgacagaaaagctgtccagactgacaccgaccgcaaacagcaacagtcccgagcctgccggagatatgagcggcccgtccgattgtttaaacgcggcgatcatcatctgcacccctaaaatgaaaagaagagatccgccgatgtaaacggcgagcatccccagaaaaccggacagcagatgcccggccgccattcctacaagcggcatcatgacatgaaacagcccgatgacaacccctatatgaaaaatctgttttttcttcagctgaatcattcccattccgagcccgacggaaaaggcatccgtccccaaagcaaatgccatgatgcttaaggagacaagttccccgatgaatagattcgacatgaataaaaacccccttggacgtgcccgcttgtttagcttatgcatgtccgataaggggtagaacaagttaatggataacggtgccgcctgcggctttcatcagcctgttcataacggcgagccccactccggtatccggaaaggactcagaaataatcatatccacttccgcttcatcaaagctgcggagcgcatcgtataaggcggacgccactgtttcaaggtcggcgcgtctgccgcagaccttgatataatcagcctggtaactatcggcgttctcttctgttgtcaaaatgccgattcgttttccccggcttttatatgcgtctgccagttcttgaattctccgggcgccgccgtcggcaatagccatcggcgcagaaggcgcgtaatgtgtatatttcataccgggagaaataggaacctcatcttcttcggtcagtcctttatccacaagaaccggaccggcggcggattcaatctgctcttttgtcacgccgcccggacgaagcagcacgggctgtttccccgtacaggacagaacggttgattccactccgattcccgtcgcgccgccgtccacaataccggcaatacggccgtttaaatcatgagctacatgctcggccttcgtcgggctcggttttcctgataaattggcgctcggcgcggcgatcggcagtccggccgagctgatgagggctaatgctgccggatgatcaggcattctgaccgctaccgtctccagtcccgcggtgacacggggtgacagcacaccgggcttacacggcaggacaagggtcagcgcccccggccagaatagctccataagctttttcgccgtctcaggaatatggctgataaaacgatcaagctggctgatatgggatatatgcacaatcagcgggttatcgctcggccttcctttcgcctcatatattttcgttacggcttccgtattttcagcgttagcgcccagtccgtaaacggtttctgtcggaaaagccacaacctcattctgccggagcaattccgcggcttgtgtaatttggggatcggttgtggataattctgcggaacaatccacaaaccatcttcttgttttcatgtataaccaaactccttattttaaagcggtaaaactttattttctctcgtgtattccttttgaaagtataaaagatgtcctttaataaaacaagcgttatccacaaactgtggacaacactttttaataagtggataaccttgtgtataagttagatcaggcagaggttttcaccattaaaaacgaaccttctgtgcataacgagttgcggaaatgttcggacgtatacagttcctcaggcgcatcggcgcacgcttcaaatcccatcacattcagaaactcagcagatgagggctgattggcgactaagtagacatcttgaatttcatgttttttgcacagcacatccatactttgaaacagtgtaacgatatggctttgattcagcctgtccgacatgacgagtgaacggagaagcccttttccgccgctgaatttttcgatcccgagacaggcggcaatctttttttcgctgtcttccagcacgataaaccggctgatctgctgatcgatttccgcatgtgccgtatcagactttttcaaaaaggcctccagcgcctccgtatcttgatctcttgccactctcagctgataaaacatatatttccctccgtttcgatcaactctttcttccaatctatgaatcgaatccggatttatgccttttgcttcaggaaaatagatctgaaatccaatcgacgaggaaaaacttcacttcggtatcatcgtcatctttattttctttcttcgctttatcggcctttgcttttacgtcatccagcactttttctgtctgtttctgcgtttcttcctgcttctgtccgccgtcttcctgatctttcaccgcttcgccgtttgagaaatcaaggaagcacagcggcggaaacaagacgcaccaccagttggcgccctcgccattgccgagtgtaattaaaatggcttcatattttccggccggatagaccatattgccgtacagctttgtcggaaacgagattttattgaattgaactgaaacggattgatgcgcacccttttctttcatcgtttgtttggcgatttctttaatttcaggaagcttcgaacgaatgagccgccgcgcttcttcaatggaagtgatatctttcacccagtccgtgatttgcttgtttacagcatctctgatctggcgcttgagcttttgatcctcatcgttatcactgttggccaaaatcctgagccggatcgcttcatccggtatgacgacgggctcatcggctgatgcccgcgccgtttcttcttttgtcaaacccgcaagcgctcctgataataaaagaaaaatatatatgcagatcatcattgtctgtttcatcggtccccaccgttcctctccgtgctttttttatctagtcccattatggacatgacggaaaaggtttaaaccggcgggaagaaaaaaatctagcaagctgataatctgcattgacagattcaaaatatggtacgatattattttgataggaggttttcagatgaaatataattacaccgtgctgctgtcggcggcatgtatgtctgtcatttattctattttgtatgttcatcaattcattatcgcggctttcatttcgatggcgttttattttttgtttccttatttgatttttgcgctgccgcttcaatactttctgaataaaaagccgaagagatttcatccgctgtattttctttattatttgggggtgtcgttcattgcaaacgggatcatcttcggtcttttgcagccgtcaggccaatctctgttttctaattcagccttttatatctttgcggttttaacagccgtcgtctattgggtatgggattccgtattgctgcaaagacaaaatccggctacagaagcgtaatcagcagacagccggctgaagggagagcggcgcaaaagaaaacggcggccatctttaaacgggcgcgccgtccttcttctgtttcagaatgataattggcccgctgctccgctccgcttacggccagcccggaaacgatgaccgctgcgacgataagaacagccgtaacggcgccgagaatgatgtcaaagccaaacggcaggacaaatccagccgcataagctgcggcggcgagtatacatccgaaggcgaacgcttttttcaaggcggatgcccctttcattttctttccattgtaacaaaagcccgccgtgtgcgtcaccggcgggcttttttcatgatgtgatgaccgcggatacggttctgtcttttccgttgatgtcctgtacgacttccacttccgcattcggaaaggaatgacggaacaggtctttcacggcttttccctgattatatccgatttcaaagacgacaagcgctttatctttcatgacaagaggcagctcctccataaaccgcttgtagaatttcaaaccgtcaccgccgtccgtaagtgcatgaagcggctcatggaaacggacgatatccgacaaatccgccatttcttcttcagaaatatacggcggattggaaacaataatatccgcttttattcctgatgaaataaaaggagttaacagatctccctgcaaaaagcggacgtccgctccgaggttttgcgcatttctttccgccacctgaagcgcttcttttgaaatgtccgaagccgatactgaaaaatgtccgcattcaagcgcgagcgtcaccgcaatggctccgctccccgtaccgatatcaatgacgttcaggcgttctccctcagaaaacacccgcttctgtctgtccagcagatgaaagacgacttcttccgtttccggacgcggaatgagaacatcgtcattcacaaagaattctctgccgtaaaactgttctttcccgataatatattgaatcggaacgccttctttatgcatttccacatgccgtctgaatcggtaaagctcgtcctcgccgacgggctcctgcagacttgcgagaagcttgctccgatccattccggtatcatttaacagcagcagctcggccgcgtttttttctcttcccgcttcggttaaataagaagaagcccagcttagggcttcaaaaacggtcttcatcttaattttccgcctgctggagcttgcttgactggtcttctacgattaacgcttcaaccacttcatcaagcttgccttccaggatttgatccagcttttgaatcgtcaggccgatacggtgatccgtcacacggttttgcgggaaattgtatgtgcggatacgctcggaacggtcgcctgatccgacggctgatttacgggtctgatcatattcagcctgagcttcctgctggaatttgtcatagattctggcgcggagcaccttcatcgctttttctttatttttaatctgagatttttcatcctgacaggatacgacgacaccggtcggtaaatgcgtcaggcgtacggccgacatcgtcgtatttacgctttgtccgcccggtccgcttgatgcgaatgtatcgacgcggatgtctttttcgtggatgtccacttctacttcttccgcttcaggaagacacgccaccgtcgccgtggatgtatgaatacggccgcctgattccgtttccggcacacgctgtacgcggtgcgcgccattttcatacttcagcttggagtatgcgccttttcccgtaatcataaagatgatttctttgtaaccgcccgttccggtcacgtttgcttccatgacttcagtcttccagccttggatttcagcgtaacgggagtacattctgtagagatttcccgcaaacagcgcggcttcttctcctcccgctgctccgcggatctccatgattacgtttttgtcatcgttcgggtctttcgggatgaggagcactttcaaacgctctgataaggtttccgtctctccctgcagttcggagatttcttccttcaccatttctctcatatcggcatcaagcttttcctcaagcatcgctttcgcatcggcaagctgttctgatgcgtctctgtattgtctatagacttcaacggtttcttgtatatcagattgctctttcgaatattctctaagctttttcggatcgttgaccacttccggatcacttaaaagctcatttaatttttcgtatcgttgttcaattgactgtaaacggtctaacacggtcttcacctctgttttcctgtgcgtaacattctcattatagtatagggcttatcaccagtcaaaagcaattcgcctctgttatactgaagcaaaaaaggaggggcggatatgctgaaatccatccaccatatagcaatcatatgctctgattatgaaaagtcgaaagctttttacaccgagatactcggtttcggcattataaaagaaacataccgaaaggaacgggaatcttataaactcgatctggcgctggacggcgcgtatgcgattgaattgttttcctttcccgatccgcccgaacggccgaccagaccggaagccgcgggtctccggcatctcgccttcaccgtaaacgatcttgaagcagccgtcagggagttaaagaaaaagggcgtcggcacagaaccgatcagaaccgatccgctgacggggaaacggtttacctttttcttcgatcccgacaagcttccgcttgaattgtatgaagcgtaacgttttttgaagaaatgccgctttctttggcgaattccttcttgttttgtctaacatgaagggaacgccgcctcatggtcgaatacctagcaaaaaggaggtatgtgatcatgaatacaaacatggccgcgaaagagctcggcgtctccgcaaaaacggtgcaaaggtgggtcaagcagctgaatcttccggctgaacggaatgagctcggacattattcctttacacctgaggatcttgatgtgctgaaatcggtcaaacggcaaatttctgaaggcactgcccttctggacgttcaagtgccccggcagccgaaaaaacggacgggcttcattttgcagcgtccgaaaatcaatggcggcgctgaacaaaggttggcagagctggagcgcaaactggacattctcacgaaagagaaacaggatgagaaccatctgctttcaaggatagaggagcttgaacgccagctgaaacaaaaggcggatgaaggggtgtcttatcagcttcttcagcacagacgggaaattgacgacctcaataccgaattgcagacattggcctcccgcatccaggaacttgcccagacagctcccctctcagaaacagccgcttcttcagaacataagaaacccagaaaaaaaacgagattttcgccttttaaatttcaattctaatcaaaaaagctccctgaaacagggagcttttcattatgcagtcagcgcaatgatgatcggcagtgagataagagataaaatcgcactgatcacgaacgcggacgcagtttcttcctcttgtttttcgaaacgtgtggcaatcatcgccgctaccgcagatccagggaatgcgacgagcaataccgctttagtgatctggtcagccggaagtccgactgcaagagcgatcaagtacatcagcgcaggctgaacggcaacttttaacaaagcgataccgaaagccggcagactgagcttgatgttgcggataccgacagttacaccgacggcaaagagtgcaacacctgatgttgtgcttccgagctgatcaagcattttttcacccaagccagggagtgttacaccgcagagtaccaggatgatactgataagcggtgcagccgcaagcggttcggaaagaccgtgaagaatagacttaccagtcattttccagaagttctcgttttcgctgtcttgtttcttagatgactcaccgactgtagcgataatgatcgcaagcgggtcaaggatggcgttaaccacgatacccgtaacggcgataggaatcgctacttcgtttgctccgaataagcttccgagtaccggaatacccataaatgcaaatgtcggctgtgcagagtttaaagaaaatacagatgaattcgttaaatcatacttgaagataaatttgcaaaccaacaaaatgacgataaagaatccgacaatcccaatgatcaaagcgatcattaaaggaacctgtgataaaaacgcacttcttgaagtggttaaaatacttgcgataaaatgcgccggaagcgcgtacttcgtaactaaggtgcttaccccttttgctgacttcgcgtcataacttccgaagcgacctgcgaaccatcccagcacgatcacgaaaaagatcggcgccaggaggattaaaatatctaagaagctcaaaatattctcctccaaatccttaatgtccgtatactttagcctttacataaaagctttccctcggactgtaaaattaatcgtaaaaattatttagcgataacttgtttatattgcggtttccacattgcatcaagaacggcttgttctacattctcaggaatgcggtttgccacgccttctttaatggcagtttccgctacggcgatcgcaactttaattgaaacttcttgtaagtcgctcatgctcggcagaaggcctgcacccggtgtttcaaaatcaacgctttctgcgattgcgtcagcagttgccgcaaacattgcaggagtaatcactttcgcttctacaacgattgaaccgagaccaagtccagggaacgcgaatgcgttgttagattgtccgatttcatgagaaacgccattgtactctacattgtcaaacgggcttcctgtcgccacaagcactttgccgtcagtccatttgaatagatcgctaggaacggcttcagcaagcggtgtcgggttagacatcggcatgatgaccggacgctcaacgtgttttgccatttctttgacgatttcttcactgaacgcgccgctttggcctgatgtaccgattaagattgtcggtttcgcttgacggatcacttcaatgaaaggaatttgtccgttttcatcgcgtttccaatctttaatttcttcagctgtgcgcaggtacggctcttggaaatcaagaatgttttccataccttcaattaacaagcctctgtagtccattgtgtagaacgctttgttggcttcttcttcagaaagaccggcaagcaccatagtgtcgcggatttggtcagcgattccgattccggcagatcccgcaccgaagacaaccacacgctggtctttaatagacgcgcctgtttcttcatagccgcaagcacacctgcaagcgtatcgcgcctgttccttgaatgtcatcgttgaatgtaagaatttcatgattgtatttcttcatgatattgcgcgcgtttttgtttccaaggtcttcccagtgaagaagagctttagggaaatatttaagcgcagcttttacataagcgtcaatgaaagcttcataacgttcgccttggatacgttcatggcggttaccgatgtataaaggatcgttcagaagtttttcgttgttcgtaccgacgtcaagaacgacaggaataacacggcttgggtcaataccggcagcagctgtgtatacggctaatttaccgatggcgatgttgataccgcctacaccccagtcaccgattccgaggatgcttctgagtctgtcgcaacgatcagatcaatatctccggcagtggcatgaaggttttcaaatgcctcttcgattccttctacattgtcgatagaaaaggtaaatcccttgaggtcttctgtactcatggctgtattcttgaatcgcttcaccgacagtcggtgtgtaacaaccggcagcatttcacgaagatggttttgaagcaatttaaagaaaagaacttcgttacggttttgcaaatcattcaaatacacgttttggcgaaggcggtccggctgagcttgaaactgctcgtatgcgcgttttgcctgctcatcaagagacagaatggtcggaggaagcagccgtctaatccaaggctttttctttcttctgctgaaaacgcaacacctttatttaaagtagggatagtagaacttcttttcctcttaaagtgtttctaagttgccttccttcgtttactttaatatattcaagaaaatctccttctttcttcaaatagttaacaaagttaagtaattacccattttggctagtgtgatcgcgatctgctatatctttttttgacaattattcgaacaatgtctcataactatttacattacttagtcattttatgcctgtaaaaatgaaattcaagagatgaaaattacttaattttttcatactcttttttaagttaattaactacaatttttgaaaaacgtcaaaaaacaccggattttttaccgatgttttcatgaaaagggttatttatcgtctgttttttcagcacttcgtggtgatgtctgcatctcgcttcgtatgactccgacgcgccgactaaaatgaccggatcatcataggagcgggcttccgtcaatcaaacgctgcgtacggcttgccggcgacccgcaaacggagcagaccgcctgcagcttcgtcactgattcggcaaccgccatcagattcggcaccacaccgaacggctctccccggaaatccatatcaagtccggccgcgatgacacgatagcctttatccgcaagcaaggataaatcgccgatgattgattcgccgaaaaactgcacttcatctaccgcgatgacgtccgtgctttcactgatatgatcccatatttcagccgaagacgagatgacgtggcttgtcatggatgtgccgttgtgagaaacgacagcctcctcactgtagcgattatcaatggcaggtttgaacaccttgacctcctgcttcgcatatgtcgctcttttcactctgcggatcagctcttctgatttccagagaacatgctgcgcatatcagctcaagccatccgctttgcttcattatgtacataggctatccgctcccctttttttcctgtttatggacataaaaaaaggcaagaagcaattcttgcctgcctgtaaatctattattacttaagaccgtattttttgttaaagcgatcaacacgaccatcagcagaagcgaatttttgacgtccagtgtagaatgggtggcattcagagcaaatctcaacgcgtacctcttcttttactgagcctgtttcaaattcatttccgcaagcgcatttaactgttgcttttttgaaattaggatgaattcctgctttcattgtatccatctccttccgccctgaatcccgtgtggaaacagagttattattccggagcgaatccggaacgcatatgagagaattatatcagtcatttactgcatttgcaaatacattttttatcagcggcgggctgatgatgaaaggtttgcctgcttccattcttggttgatcagatcgaagaattcctgattcgtttttgttttttcattttctcataaacttctgcgaagtcggagaatcagacatcgattgcggatcgcccatagacggtcaagatgctctttcggcacgagcagctcttccttcgcgtgccgccggaaaatccgtctttccgcaagagcggttgcaaactctcatagatgacgtcatccatccgggagcccgtgtctacgagcgccgtcgttcagccgcgtttccggaaaaagcgcttcggaattcagccggaagcgtacccgcttggcgggataaccgtctgccatcgttccgcgaccgctcgcggaatccgccgcggccggtcggccggttttgtagagcccgtgccagcgggactgtccatcagaatgccgttttttttttttaacagcatggttttttactaatttggcatcgaacgtcgactgacgacatccgctacgaacccgaccttcggttttcatcaattaagagacgatcaattcagcgtcaggagatttgtcgtaatgtgttagcctttttaacagcatggtttccggctttcggcggagtcagaccgctggccgaaaccgacgggccatcatatttcggttctttcggcgggattcagcgcaccgcacggccgttccgtaatagcgttcgttttcttacgcaccttgccggatactttgtcaccgtttcttaaatcaaagcggcggatctgggaagcagaaatgtagatgtcttctgagcttggcgagtaattaatcggtctgaggaagccgaatccttccgattggatgatttcgagcacgccttccataaacagaagatcctcctgctcggcgttggctttcaggatggcaaagattaattcttttttagtcagtttgctgtagtaggagattttataatgtctggccagttcatatagttcttttaatttcatattttccaaagaggaaatagatacgtctttcataaaaacaccacgcttttcatagtcaatgtattgctgttttcattcaaatcggctgcttcgcatgattccgccaaagcacattcttttataaaacgttcaggaacttctatcggtaacacttccacccatgatcggcgcttttttaaaaaaggaatgtcttaatgagttttgaaggaagcgaggacaaaaacttgagaagatcaatatttatatcgtctgtatgcggtagaatttgaaaatttcccagtactcaaaagaaggaatgacacagaaaaatcgcagcactctttatttttacctcatttcaaaaaattattcaacttaaataatgctttgacatataaatgatagggttgactcttttttgcaaaagaaaagcgggactttccgtcccgcttttctctatttatggccggatcacaagatttggttttttcttcaggctgtgtcttccgtcaacgaatcggaccgttcctgatttcgcccggatgaccaggctttcagtcgtgccgacggagcctttgaactgaacgcctttcagcagctctccgtccgtgacacccgttgcggcaaaaatggcgtcatcccctctcacaaggtcctccatccggagcactttggatacatcaaggcccattcgctcacagcgggcctgctcttccgcactttgcggcagaagcctgccgatgatttcgccgccgagcgcttttaacgcaacggcagacagcgccttcaggagccccgcctgaaccgaagagaatgtctactcccgtatggtcaaaggccgtattgatggcgcccgcgacatcaccgtcgttgatcagtttgattctggcgccccctcacgcaattcagagatgattttttcgtgtctgtcacgatttaaaatggttgccacgacatcttcaatgtctttgtttttcgctttcgcaacggcttttaagttatcaatgacaggcgcttcgatatcgatgcagcctaccgcttcgggaccgaccgcgattttttccatatacatatccggggcgttcagcaatgttccatggtcggcgaccgcgatcaccgtcagcgcattccagccgccgctcgctacgatgtttgtgccttcaagaggatcgacggcgacatcgacgcgcgggccgtatccgtttccaagcttttcgccgatgtaaagcatcggcgcttcatccatctcgccttccccgatcacgaccgtgcctttcatcggcaccgtgtcaaacacgtcacgcattgcgcttgtcgccgcatcatcagcttcatcttttttcccgcggcccatccatctggcagatgctaaagccgccgcttcagtgactcgaaccaattccatcgataagcttctttccatttcaacacgatctcctctcaaaagtccgcatttctatgaattttggagctgttctatctcttcgtccgtcagcctttgccgccagattgtggcgcccagaccttcgagttttttctcaagattgctgtagccgcggtctaaatgctcaagaccggtaatttcggttacgccgtcagccatgagcccggcgacgaccagacaagcgcctgcacgcagatcgctcgcctttacttttgcgccctgaagctcggccggaccggtgataatggccgacctgccttccactttcatattggcccccatccgtctcagctcatcaatatgtttaaatcgggccgagtagatggtgtcggttacgacgctcgtgccgctggctctcgttaacagagatgtcatcggctgctgaagatcagtcgggaatcccgggtaaacaagcgttttcacgtcgaccggttttatctgcttctgcccgccgagcataagaagctgatcgtcactcgtctcaatgtaaaaacccatttccctgagcttcgccgttaaagactccaggtgagtcggtatgacattatcaataatgacttctttccccatcgcggcgccggcgatcataaaggtgcccgcctcaattctgtccggaatgatcgtatgcctgcatccgtgcagcttttacgccgtcgattctgattacattggttcccgcacctttgatctttgcgcccatgctggtgagcaatgtggcaacatcaataatctcaggttccttggcggcgttttctatcacggttttaccttcagccagtacagcggcaagcatgatattaatcgtcgctccgacgctgacgacatctaaataaatccgtgcgcctctcagcctttcggcgcgcagataaatcgcgccttgttcattggtgacttccgctccaagcgcctcaaaccctttgatatgctggtcaatcggccgcggaccgagatggcatccgcccggcagtccgatgaccgcctgtttgaagcggccgagcatcgcgcccattaagtaataggaagcgcggagttttttcactttgccgttgggaagcggcatgctgatcatcggggaagggtcaacgaccatttctcctttttcaaaatggacgtttccgccgatttctttcagcaggtcacgcagcgtttcaatatctgagatctccggaagcccttcgatcgttacttcggaatttgccagaatggttgcgggtatcaatgcgacggcgctgtttttcgcaccgctgatgtacggttccgtttaacggatcgccgccggcaatattcaacttttccatgatagtctccttccataagaagatagctgcggagcgtaaataaaatggcattttattctgtctctgcaaataaagctcttgtccaaaatgtagccaattcgaagagaaagaatacaaggacattataaaataacaggaagaaaatagcgaagctttgcggggcatttttaacacaggatgcacagaggcccgccgggttcatattccggggaaacacactcttcactttgatactgaaggcccgctgccaaacaggaaaacataagggtgcggcaaacggatgcaaccggtttgccgcccttttcccccttatttattccagtcagccaagaattgctcgatgcctttatccgttaacggatgtttcgtcagctggtgaatgactttcagcggcatcgtaccgatatgcgcaccgcgtaaagcggcttcagtcacgtgctgcgcatgacggatggaagctgcgatgatttgagtatcaatgtcatgaatgtcaaaaatctgtcttatttctgaaatcagttcaagaccgttatggccgatgtcatccacggcctaagaacggagatacataagtcgccccggctcttgccgccaaaagcgcctggttggcgctgaaaatgagcgttacgtttgttttaatgttcaggtcgctcagcgcttttacggcttttaacccttcagacgtcatcgggattttcaccgtaatattcggcgcgattttcgcaagttctttaccttcttcaatcatttcttcagcattcagggaaatgacttccgcgcttactgatccgctcacgacttccgtaatctcacgaagtctgtcatggaaagacacgtcagcttctttcgccactaaactagggtttgtcgtaactccggcaagaacgccaagttcataagcttctttaatctcgtcaatgtttgctgtatcaatgaaaaataacataaggaaagcctcccagtaataaattttcagaactgtaaaacatgattgcgctttctaaaggtaagacataaaaccgcctgtcaatgctgtcaggcggtttatggatgttacattggattaagcttggtttgaagaaccgaactcacgcattttgccgataaccgtttctttgatcgcttcacgagcaggtccaagatatttacgaggatcgtattcgttcggcttagctgccaatgtttcgcggacagcttttgcagaagaaatttggttttcagtgtttacgttgattttagccgtaccaagtgagattgattttttaatgtcggcagtcggaattcctgtaccgccgtgaagtactaacggaaggccggttgatttgccgatatcttccatttctttgaaaccgaggttcggttcgcctttgtaagggccgtgaacagaacccagtgcaggtgcaaggcagtcgatgccagtgcgctctacaagttcttgacactctttagggtcagcatagattacgccttcagcgatcacgtcatcttcctgtccgcctacagttccaagctcagcttcaactgaaacgccgtggaaatgagcaagctcaaccactttagctgtagttgctacgttttcctcaaacggatggtgagatgcgtcgatcattacagaagtgaaacctgcatgaatcgctttcgcacaagattcaaagcttgaaccgtggtctaagtgaatcgcgacaggaactgtcactttgtattcttccataagagctttaaccatggcaaccactgttttgaagccgcccatgtagcgtcccgcgccttctgaaacaccaagaataaccggggatttttcctcttctgctgcttgtaaaatagcttgagtgaactcaaggttatttaagttaaattgt
